US011639509B2

(12) United States Patent
Samulski

(10) Patent No.: US 11,639,509 B2
(45) Date of Patent: May 2, 2023

(54) METHODS AND COMPOSITIONS FOR DUAL GLYCAN BINDING AAV2.5 VECTOR

(71) Applicant: The University of North Carolina at Chapel Hill, Chapel Hill, NC (US)

(72) Inventor: Richard Jude Samulski, Hillsborough, NC (US)

(73) Assignee: The University of North Carolina at Chapel Hill, Chapel Hill, NC (US)

( * ) Notice: Subject to any disclaimer, the term of this patent is extended or adjusted under 35 U.S.C. 154(b) by 0 days.

(21) Appl. No.: 17/581,639

(22) Filed: Jan. 21, 2022

(65) Prior Publication Data

US 2022/0136010 A1 May 5, 2022

Related U.S. Application Data

(63) Continuation of application No. PCT/US2021/056582, filed on Oct. 26, 2021.

(60) Provisional application No. 63/106,733, filed on Oct. 28, 2020.

(51) Int. Cl.
*C12N 15/86* (2006.01)
*A61P 31/18* (2006.01)
*A61P 31/20* (2006.01)
*A61P 1/16* (2006.01)
*C07K 14/005* (2006.01)
*C12N 7/00* (2006.01)

(52) U.S. Cl.
CPC ............... *C12N 15/86* (2013.01); *A61P 1/16* (2018.01); *A61P 31/18* (2018.01); *A61P 31/20* (2018.01); *C07K 14/005* (2013.01); *C12N 7/00* (2013.01); *C12N 2750/14122* (2013.01); *C12N 2750/14142* (2013.01); *C12N 2750/14143* (2013.01); *C12N 2750/14171* (2013.01)

(58) Field of Classification Search
CPC .............. C12N 15/86; C12N 7/00; C12N 2750/14122; C12N 2750/14142; C12N 2750/14143; C12N 2750/14171; C12N 2750/14145; A61P 1/16; A61P 31/18; A61P 31/20; C07K 14/005
See application file for complete search history.

(56) References Cited

U.S. PATENT DOCUMENTS

| 4,501,729 | A | 2/1985 | Boucher et al. |
| 4,968,603 | A | 11/1990 | Slamon et al. |
| 5,399,346 | A | 3/1995 | Anderson et al. |
| 5,863,541 | A | 1/1999 | Samulski et al. |
| 5,869,248 | A | 2/1999 | Yuan et al. |
| 5,877,022 | A | 3/1999 | Stinchcomb et al. |
| 5,882,652 | A | 3/1999 | Valdes et al. |
| 5,905,040 | A | 5/1999 | Mazzara et al. |
| 5,916,563 | A | 6/1999 | Young et al. |
| 6,013,487 | A | 1/2000 | Mitchell |
| 6,083,702 | A | 7/2000 | Mitchell et al. |
| 6,156,303 | A | 12/2000 | Russell et al. |
| 7,071,172 | B2 | 7/2006 | McCown et al. |
| 7,201,898 | B2 | 4/2007 | Monahan et al. |
| 7,892,809 | B2 | 2/2011 | Bowles et al. |
| 9,012,224 | B2 | 4/2015 | Bowles et al. |
| 2002/0192189 | A1 | 12/2002 | Xiao et al. |
| 2003/0017131 | A1 | 1/2003 | Park et al. |
| 2004/0013645 | A1 | 1/2004 | Monahan et al. |
| 2008/0269149 | A1* | 10/2008 | Bowles ............ A61P 43/00 435/320.1 |
| 2016/0017005 | A1* | 1/2016 | Asokan ............ A61P 31/14 435/320.1 |
| 2018/0135076 | A1 | 5/2018 | Linden |

FOREIGN PATENT DOCUMENTS

| WO | 9005142 A1 | 5/1990 |
| WO | 9811244 A2 | 3/1998 |
| WO | 9906160 A1 | 2/1999 |
| WO | 0017377 A2 | 3/2000 |
| WO | 0028004 A1 | 5/2000 |
| WO | 0028061 A2 | 5/2000 |
| WO | 0192551 A2 | 12/2001 |
| WO | 03095647 A2 | 11/2003 |
| WO | 2006021724 A2 | 3/2006 |
| WO | 2006029319 A2 | 3/2006 |
| WO | 2006066066 A2 | 6/2006 |
| WO | 2006073052 A1 | 7/2006 |
| WO | 2006119137 A1 | 11/2006 |
| WO | 2007089632 A2 | 8/2007 |
| WO | 2007100465 A2 | 9/2007 |
| WO | 2008088895 A2 | 7/2008 |

(Continued)

OTHER PUBLICATIONS

International Search Report and the Written Opinion of the International Searching Authority corresponding to International Patent Application No. PCT/US2021/056582 (13 pages) (dated Feb. 16, 2022).
Adachi et al. "Creation of a Novel AAV2 Vector Showing AAV9-Like Transduction Properties by Displaying a Galactose Binding Motif on the Capsid" American Society of Gene & Cell Therapy Final Program Addendum, 15th Annual Meeting, 816:34-35 (2012).
Adachi et al. "Drawing a high-resolution functional map of adeno-associated virus capsid by massively parallel sequencing" Nature Communications, 5(3075):1-14 (2014).
Andino et al. "AAV-mediated knockdown of phospholamban leads to improved contractility and calcium handling in cardiomyocytes" The Journal of Gene Medicine, 10:132-142 (2008).

(Continued)

*Primary Examiner* — Titilayo Moloye
(74) *Attorney, Agent, or Firm* — Myers Bigel, P.A.

(57) ABSTRACT

Disclosed herein are methods and compositions comprising an adeno-associated virus 2.5 (AAV2.5) capsid protein, comprising one or more amino acids substitutions, (e.g., which does not contain a substitution at the position corresponding to amino acid 267 of AAV2.5, or does not contain a serine at the position corresponding to amino acid 267 of AAV2.5) wherein the substitutions introduce a new glycan binding site into the AAV capsid protein.

24 Claims, 2 Drawing Sheets

Specification includes a Sequence Listing.

(56) References Cited

FOREIGN PATENT DOCUMENTS

| WO | 2014144229 A1 | 9/2014 |
|---|---|---|
| WO | 2020219656 A1 | 10/2020 |

OTHER PUBLICATIONS

Arruda et al. "Regional intravascular delivery of AAV-2-F.IX to skeletal muscle achieves long-term correction of hemophilia B in a large animal model" Blood, 105:3458-3464 (2005).
Bantel-Schaal et al. "Human Adeno-Associated Virus Type 5 Is Only Distantly Related to Other Known Primate Helper-Dependent Parvoviruses" Journal of Virology, 73(2):939-947 (1999).
Bell et al. "Identification of the Galactose Binding Domain of the Adeno-Associated Virus Serotype 9 Capsid" Journal of Virology, 86(13):7326-7333 (2012).
Bell et al. "The AAV9 receptor and its modification to improve in vivo lung gene transfer in mice" The Journal of Clinical Investigation, 121(6):2427-2435 (2011).
Bowles et al. "Phase 1 Gene Therapy for Duchenne Muscular Dystrophy Using a Translational Optimized AAV Vector" Molecular Therapy, 20(2):443-455 (2012).
Brichard et al. "The tyrosinase gene codes for an antigen recognized by autologous cytolytic T lymphocytes on HLA-A2 melanomas" Journal of Experimental Medicine, 178:489-495 (1993).
Chiorini et al. "Cloning and Characterization of Adeno-Associated Virus Type 5" Journal of Virology, 73 (2):1309-1319 (1999).
Chiorini et al. "Cloning of Adeno-Associated Virus Type 4 (AAV4) and Generation of Recombinant AAV4 Particles" Journal of Virology, 71(9):6823-6833 (1997).
Deutscher et al. "Mechanism of Galactosylation in the Golgi Apparatus" Journal of Biological Chemistry, 261(1):96-100 (1986).
Fang et al. "Stable antibody expression at therapeutic levels using the 2A peptide" Nature Biotechnology, 23:584-590 (2005) (Abstract only).
Gao et al. "Novel adeno-associated viruses from rhesus monkeys as vectors for human gene therapy" Proceedings of the National Academy of Sciences USA, 99(18):11854-11859 (2002).
GenBank Accession No. AF513851 "Adeno-associated virus 7 nonstructural protein and capsid protein genes, complete cds" www.ncbi.nlm.nih.gov (3 pages) (Sep. 5, 2002).
GenBank Accession No. AF513852 "Adeno-associated virus 8 nonstructural protein and capsid protein genes, complete cds" www.ncbi.nlm.nih.gov (3 pages) (Sep. 5, 2002).
GenBank Accession No. J00306 "Human somatostatin I gene and flanks" www.ncbi.nlm.nih.gov (2 pages) (Jan. 13, 1995).
GenBank Accession No. NC_001401 "Adeno-associated virus—2, complete genome" www.ncbi.nlm.nih.gov (6 pages) (Aug. 13, 2018).
GenBank Accession No. NC_001729 "Adeno-associated virus—3, complete genome" www.ncbi.nlm.nih.gov (3 pages) (Aug. 13, 2018).
GenBank Accession No. NC_001829 "Adeno-associated virus—4, complete genome" www.ncbi.nlm.nih.gov (3 pages) (Aug. 13, 2018).
GenBank Accession No. NC_001862 "Adeno-associated virus 6, complete genome" www.ncbi.nlm.nih.gov (3 pages) (Jan. 12, 2004).
GenBank Accession No. NC_001863 "Adeno-associated virus 3B, complete genome" www.ncbi.nlm.nih.gov (3 pages) (Jan. 12, 2004).
GenBank Accession No. NC_002077 "Adeno-associated virus—1, complete genome" www.ncbi.nlm.nih.gov (3 pages) (Aug. 13, 2018).
GenBank Accession No. NC_006152 "Adeno-associated virus 5, complete genome" www.ncbi.nlm.nih.gov (3 pages) (Aug. 13, 2018).
Gorman et al. "Stable alteration of pre-mRNA splicing patterns by modified U7 small nuclear RNAs" Proceedings of the National Academy of Sciences USA, 95:4929-4934 (1998).
Gregorevic et al. "Systemic microdystrophin gene delivery improves skeletal muscle structure and function in old dystrophic mdx mice" Molecular Therapy, 16(4):657-664 (2008).
Hoshijima et al. "Chronic suppression of heart-failure progression by a pseudophosphorylated mutant of phospholamban via in vivo cardiac rAAV gene delivery" Nature Medicine, 8(8):864-871 (2002).
Kawakami et al. "Cloning of the gene coding for a shared human melanoma antigen recognized by autologous T cells infiltrating into tumor" Proceedings of the National Academy of Sciences USA, 91(9):3515-3519 (1994).
Kawakami et al. "Identification of the immunodominant peptides of the MART-1 human melanoma antigen recognized by the majority of HLA-A2-restricted tumor infiltrating lymphocytes" Journal of Experimental Medicine, 180:347-352 (1994).
Levine, Arnold J. "The Tumor Suppressor Genes" Annual Review of Biochemistry, 62:623-651 (1993).
Li et al. "Construction of phospholamban antisense RNA recombinant adeno-associated virus vector and its effects in rat cardiomyocytes" Acta Pharmacologica Sinica, 26(1):51-55 (2005).
Miyamura et al. "Parvovirus particles as platforms for protein presentation" Proceedings of the National Academy of Sciences USA, 91:8507-8511 (1994).
Muramatsu et al. "Nucleotide Sequencing and Generation of an Infectious Clone of Adeno-Associated Virus 3" Virology, 221(1):208-217 (1996).
Padron et al. "Structure of Adeno-Associated Virus Type 4" Journal of Virology, 79(8):5047-5058 (2005).
Puttaraju et al. "Spliceosome-mediated RNA trans-splicing as a tool for gene therapy" Nature Biotechnology, 17:246-252 (1999).
Rabinowitz et al. "Cross-Dressing the Virion: the Transcapsidation of Adeno-Associated Virus Serotypes Functionally Defines Subgroups" Journal of Virology, 78(9):4421-4432 (2004).
Robbins et al. "Recognition of tyrosinase by tumor-infiltrating lymphocytes from a patient responding to immunotherapy" Cancer Research, 54(12):3124-3126 (1994).
Rosenberg, S. A. "A new era for cancer immunotherapy based on the genes that encode cancer antigens" Immunity, 10(3):281-287 (1999).
Rosenberg, S. A. "The immunotherapy of solid cancers based on cloning the genes encoding tumor-rejection antigens" Annual Review of Medicine, 47:481-491 (1996).
Shade et al. "Nucleotide Sequence and Genome Organization of Human Parvovirus B19 Isolated from the Serum of a Child during Aplastic Crisis" Journal of Virology, 58(3):921-936 (1986).
Sharp et al. "RNA Interference" Science, 287(5462):2431-2433 (2000).
Shen et al. "Glycan Binding Avidity Determines the Systemic Fate of Adeno-Associated Virus Type 9" Journal of Virology, 86(19):10408-10417 (2012).
Shen et al. "Terminal N-Linked Galactose Is the Primary Receptor for Adeno-associated Virus 9" The Journal of Biological Chemistry, 286(15):13532-13540 (2011).
Srivastava et al. "Nucleotide Sequence and Organization of the Adeno-Associated Virus 2 Genome" Journal of Virology, 45(2):555-564 (1983).
Summerford et al. "Membrane-Associated Heparan Sulfate Proteoglycan Is a Receptor for Adeno-Associated Virus Type 2 Virions" Journal of Virology, 72(2):1438-1445 (1998).
Tinsley et al. "Amelioration of the dystrophic phenotype of mdx mice using a truncated utrophin transgene" Nature, 384:349-353 (1996).
Tsao et al. "The three-dimensional structure of canine parvovirus and its functional implications" Science, 251 (5000):1456-1464 (1991).
UniProtKB/Swiss-Prot Accession No. P01166 "Somatostatin precursor [Contains: Somatostatin-28; Somatostatin-14]" www.ncbi.nlm.nih.gov (3 pages) (Sep. 15, 2003).
Vincent et al. "Long-term correction of mouse dystrophic degeneration by adenovirus-mediated transfer of a minidystrophin gene" Nature Genetics, 5:130-134 (1993).
Walters et al. "Structure of adeno-associated virus serotype 5" Journal of Virology, 78(7):3361-3371 (2004).

(56) References Cited

OTHER PUBLICATIONS

Wang et al. "Adeno-associated virus vector carrying human minidystrophin genes effectively ameliorates muscular dystrophy in mdx mouse model" Proceedings of the National Academy of Sciences USA, 97(25):13714-13719 (2000).
Xiao et al. "Gene Therapy Vectors Based on Adeno-Associated Virus Type 1" Journal of Virology, 73(5):3994-4003 (1999).
Xie et al. "Canine parvovirus capsid structure, analyzed at 2.9 A resolution" Journal of Molecular Biology, 264 (3):497-520 (1996).
Xie et al. "The atomic structure of adeno-associated virus (AAV-2), a vector for human gene therapy" Proceedings of the National Academy of Sciences USA, 99(16):10405-10410 (2002).
Zhang et al. "Recombinant adenovirus expressing adeno-associated virus cap and rep proteins supports production of high-titer recombinant adeno-associated virus" Gene Therapy, 8:704-712 (2001).
Extended European Search Report corresponding to European Patent Application No. 21844602.9 (8 pages) (dated Dec. 2, 2022).
Shen et al. "Engraftment of a Galactose Receptor Footprint onto Adeno-associated Viral Capsids Improves Transduction Efficiency" The Journal of Biological Chemistry, 288(40):28814-28823 (2013).

* cited by examiner

SEQUENCE LISTING

<160> NUMBER OF SEQ ID NOS: 2

<210> SEQ ID NO 1
<211> LENGTH: 734
<212> TYPE: PRT
<213> ORGANISM: Artificial Sequence
<220> FEATURE:
<223> OTHER INFORMATION: AAV2.5 capsid protein

<400> SEQUENCE: 1

```
Met Ala Ala Asp Gly Tyr Leu Pro Asp Trp Leu Glu Asp Thr Leu Ser
1               5                   10                  15

Glu Gly Ile Arg Gln Trp Trp Lys Leu Lys Pro Gly Pro Pro Pro Pro
            20                  25                  30

Lys Pro Ala Glu Arg His Lys Asp Asp Ser Arg Gly Leu Val Leu Pro
        35                  40                  45

Gly Tyr Lys Tyr Leu Gly Pro Phe Asn Gly Leu Asp Lys Gly Glu Pro
    50                  55                  60

Val Asn Glu Ala Asp Ala Ala Ala Leu Glu His Asp Lys Ala Tyr Asp
65                  70                  75                  80

Arg Gln Leu Asp Ser Gly Asp Asn Pro Tyr Leu Lys Tyr Asn His Ala
                85                  90                  95

Asp Ala Glu Phe Gln Glu Arg Leu Lys Glu Asp Thr Ser Phe Gly Gly
            100                 105                 110

Asn Leu Gly Arg Ala Val Phe Gln Ala Lys Lys Arg Val Leu Glu Pro
        115                 120                 125

Leu Gly Leu Val Glu Glu Pro Val Lys Thr Ala Pro Gly Lys Lys Arg
    130                 135                 140

Pro Val Glu His Ser Pro Val Glu Pro Asp Ser Ser Ser Gly Thr Gly
145                 150                 155                 160

Lys Ala Gly Gln Gln Pro Ala Arg Lys Arg Leu Asn Phe Gly Gln Thr
                165                 170                 175

Gly Asp Ala Asp Ser Val Pro Asp Pro Gln Pro Leu Gly Gln Pro Pro
            180                 185                 190
```

```
Ala Ala Pro Ser Gly Leu Gly Thr Asn Thr Met Ala Thr Gly Ser Gly
            195                 200                 205

Ala Pro Met Ala Asp Asn Asn Glu Gly Ala Asp Gly Val Gly Asn Ser
        210                 215                 220

Ser Gly Asn Trp His Cys Asp Ser Thr Trp Met Gly Asp Arg Val Ile
225                 230                 235                 240

Thr Thr Ser Thr Arg Thr Trp Ala Leu Pro Thr Tyr Asn Asn His Leu
                245                 250                 255

Tyr Lys Gln Ile Ser Ser Ala Ser Thr Gly Ala Ser Asn Asp Asn His
            260                 265                 270

Tyr Phe Gly Tyr Ser Thr Pro Trp Gly Tyr Phe Asp Phe Asn Arg Phe
        275                 280                 285

His Cys His Phe Ser Pro Arg Asp Trp Gln Arg Leu Ile Asn Asn Asn
    290                 295                 300

Trp Gly Phe Arg Pro Lys Arg Leu Asn Phe Lys Leu Phe Asn Ile Gln
305                 310                 315                 320

Val Lys Glu Val Thr Gln Asn Asp Gly Thr Thr Thr Ile Ala Asn Asn
                325                 330                 335

Leu Thr Ser Thr Val Gln Val Phe Thr Asp Ser Glu Tyr Gln Leu Pro
            340                 345                 350

Tyr Val Leu Gly Ser Ala His Gln Gly Cys Leu Pro Pro Phe Pro Ala
        355                 360                 365

Asp Val Phe Met Val Pro Gln Tyr Gly Tyr Leu Thr Leu Asn Asn Gly
    370                 375                 380

Ser Gln Ala Val Gly Arg Ser Ser Phe Tyr Cys Leu Glu Tyr Phe Pro
385                 390                 395                 400

Ser Gln Met Leu Arg Thr Gly Asn Asn Phe Thr Phe Ser Tyr Thr Phe
                405                 410                 415

Glu Asp Val Pro Phe His Ser Ser Tyr Ala His Ser Gln Ser Leu Asp
            420                 425                 430

Arg Leu Met Asn Pro Leu Ile Asp Gln Tyr Leu Tyr Tyr Leu Ser Arg
        435                 440                 445

Thr Asn Thr Pro Ser Gly Thr Thr Thr Gln Ser Arg Leu Gln Phe Ser
    450                 455                 460

Gln Ala Gly Ala Ser Asp Ile Arg Asp Gln Ser Arg Asn Trp Leu Pro
465                 470                 475                 480

Gly Pro Cys Tyr Arg Gln Gln Arg Val Ser Lys Thr Ser Ala Asp Asn
                485                 490                 495

Asn Asn Ser Glu Tyr Ser Trp Thr Gly Ala Thr Lys Tyr His Leu Asn
            500                 505                 510

Gly Arg Asp Ser Leu Val Asn Pro Gly Pro Ala Met Ala Ser His Lys
        515                 520                 525

Asp Asp Glu Glu Lys Phe Phe Pro Gln Ser Gly Val Leu Ile Phe Gly
    530                 535                 540

Lys Gln Gly Ser Glu Lys Thr Asn Val Asp Ile Glu Lys Val Met Ile
545                 550                 555                 560

Thr Asp Glu Glu Glu Ile Arg Thr Thr Asn Pro Val Ala Thr Glu Gln
                565                 570                 575

Tyr Gly Ser Val Ser Thr Asn Leu Gln Arg Gly Asn Arg Gln Ala Ala
            580                 585                 590

Thr Ala Asp Val Asn Thr Gln Gly Val Leu Pro Gly Met Val Trp Gln
        595                 600                 605
```

Asp Arg Asp Val Tyr Leu Gln Gly Pro Ile Trp Ala Lys Ile Pro His
    610                 615                 620

Thr Asp Gly His Phe His Pro Ser Pro Leu Met Gly Phe Gly Leu
625                 630                 635                 640

Lys His Pro Pro Gln Ile Leu Ile Lys Asn Thr Pro Val Pro Ala
                645                 650                 655

Asn Pro Ser Thr Thr Phe Ser Ala Ala Lys Phe Ala Ser Phe Ile Thr
            660                 665                 670

Gln Tyr Ser Thr Gly Gln Val Ser Val Glu Ile Glu Trp Glu Leu Gln
                675                 680                 685

Lys Glu Asn Ser Lys Arg Trp Asn Pro Glu Ile Gln Tyr Thr Ser Asn
690                 695                 700

Tyr Ala Lys Ser Ala Asn Val Asp Phe Thr Val Asp Asn Asn Gly Val
705                 710                 715                 720

Glu Pro Arg Pro Ile Gly Thr Arg Tyr Leu Thr Arg Asn Leu
                725                 730

<210> SEQ ID NO 2
<211> LENGTH: 736
<212> TYPE: PRT
<213> ORGANISM: Artificial Sequence
<220> FEATURE:
<223> OTHER INFORMATION: AAV2.5G9 A267 capsid protein

<400> SEQUENCE: 2

Met Ala Ala Asp Gly Tyr Leu Pro Asp Trp Leu Glu Asp Thr Leu Ser
1               5                   10                  15

Glu Gly Ile Arg Gln Trp Trp Lys Leu Lys Pro Gly Pro Pro Pro
                20                  25                  30

Lys Pro Ala Glu Arg His Lys Asp Asp Ser Arg Gly Leu Val Leu Pro
            35                  40                  45

Gly Tyr Lys Tyr Leu Gly Pro Phe Asn Gly Leu Asp Lys Gly Glu Pro
    50                  55                  60

Val Asn Glu Ala Asp Ala Ala Ala Leu Glu His Asp Lys Ala Tyr Asp
65                  70                  75                  80

Arg Gln Leu Asp Ser Gly Asp Asn Pro Tyr Leu Lys Tyr Asn His Ala
                85                  90                  95

Asp Ala Glu Phe Gln Glu Arg Leu Lys Glu Asp Thr Ser Phe Gly Gly
            100                 105                 110

Asn Leu Gly Arg Ala Val Phe Gln Ala Lys Lys Arg Val Leu Glu Pro
        115                 120                 125

Leu Gly Leu Val Glu Glu Pro Val Lys Thr Ala Pro Gly Lys Lys Arg
130                 135                 140

Pro Val Glu His Ser Pro Val Glu Pro Asp Ser Ser Ser Gly Thr Gly
145                 150                 155                 160

Lys Ala Gly Gln Gln Pro Ala Arg Lys Arg Leu Asn Phe Gly Gln Thr
                165                 170                 175

Gly Asp Ala Asp Ser Val Pro Asp Pro Gln Pro Leu Gly Gln Pro Pro
            180                 185                 190

Ala Ala Pro Ser Gly Leu Gly Thr Asn Thr Met Ala Thr Gly Ser Gly
        195                 200                 205

Ala Pro Met Ala Asp Asn Asn Glu Gly Ala Asp Gly Val Gly Asn Ser
    210                 215                 220

Ser Gly Asn Trp His Cys Asp Ser Thr Trp Met Gly Asp Arg Val Ile
225                 230                 235                 240

```
Thr Thr Ser Thr Arg Thr Trp Ala Leu Pro Thr Tyr Asn Asn His Leu
                245                 250                 255

Tyr Lys Gln Ile Ser Ser Ala Ser Thr Gly Ala Ser Asn Asp Asn His
            260                 265                 270

Tyr Phe Gly Tyr Ser Thr Pro Trp Gly Tyr Phe Asp Phe Asn Arg Phe
        275                 280                 285

His Cys His Phe Ser Pro Arg Asp Trp Gln Arg Leu Ile Asn Asn Asn
    290                 295                 300

Trp Gly Phe Arg Pro Lys Arg Leu Asn Phe Lys Leu Phe Asn Ile Gln
305                 310                 315                 320

Val Lys Glu Val Thr Gln Asn Asp Gly Thr Thr Thr Ile Ala Asn Asn
                325                 330                 335

Leu Thr Ser Thr Val Gln Val Phe Thr Asp Ser Glu Tyr Gln Leu Pro
            340                 345                 350

Tyr Val Leu Gly Ser Ala His Gln Gly Cys Leu Pro Pro Phe Pro Ala
        355                 360                 365

Asp Val Phe Met Val Pro Gln Tyr Gly Tyr Leu Thr Leu Asn Asn Gly
    370                 375                 380

Ser Gln Ala Val Gly Arg Ser Ser Phe Tyr Cys Leu Glu Tyr Phe Pro
385                 390                 395                 400

Ser Gln Met Leu Arg Thr Gly Asn Asn Phe Thr Phe Ser Tyr Thr Phe
                405                 410                 415

Glu Asp Val Pro Phe His Ser Ser Tyr Ala His Ser Gln Ser Leu Asp
            420                 425                 430

Arg Leu Met Asn Pro Leu Ile Asp Gln Tyr Leu Tyr Tyr Leu Ser Arg
        435                 440                 445

Thr Asn Thr Pro Ser Gly Thr Thr Thr Gln Ser Arg Leu Gln Phe Ser
    450                 455                 460

Val Ala Gly Pro Ser Asn Met Ala Val Gln Gly Arg Asn Trp Leu Pro
465                 470                 475                 480

Gly Pro Cys Tyr Arg Gln Gln Arg Val Ser Lys Thr Ser Ala Asp Asn
                485                 490                 495

Asn Asn Ser Glu Phe Ala Trp Thr Gly Ala Thr Lys Tyr His Leu Asn
            500                 505                 510

Gly Arg Asp Ser Leu Val Asn Pro Gly Pro Ala Met Ala Ser His Lys
        515                 520                 525

Asp Asp Glu Glu Lys Phe Phe Pro Gln Ser Gly Val Leu Ile Phe Gly
    530                 535                 540

Lys Gln Gly Ser Glu Lys Thr Asn Val Asp Ile Glu Lys Val Met Ile
545                 550                 555                 560

Thr Asp Glu Glu Glu Ile Arg Thr Thr Asn Pro Val Ala Thr Glu Gln
                565                 570                 575

Tyr Gly Ser Val Ser Thr Asn Leu Gln Arg Gly Asn Arg Gln Ala Ala
            580                 585                 590

Thr Ala Asp Val Asn Thr Gln Gly Val Leu Pro Gly Met Val Trp Gln
        595                 600                 605

Asp Arg Asp Val Tyr Leu Gln Gly Pro Ile Trp Ala Lys Ile Pro His
    610                 615                 620

Thr Asp Gly His Phe His Pro Ser Pro Leu Met Gly Gly Phe Gly Leu
625                 630                 635                 640

Lys His Pro Pro Pro Gln Ile Leu Ile Lys Asn Thr Pro Val Pro Ala
                645                 650                 655

Asn Pro Ser Thr Thr Phe Ser Ala Ala Lys Phe Ala Ser Phe Ile Thr
```

```
                   660                 665                 670
Gln Tyr Ser Thr Gly Gln Val Ser Val Glu Ile Glu Trp Glu Leu Gln
        675                 680                 685

Lys Glu Asn Ser Lys Arg Trp Asn Pro Glu Ile Gln Tyr Thr Ser Asn
        690                 695                 700

Tyr Ala Lys Ser Ala Asn Val Asp Phe Thr Val Asp Asn Asn Gly Val
705                 710                 715                 720

Tyr Ser Glu Pro Arg Pro Ile Gly Thr Arg Tyr Leu Thr Arg Asn Leu
                725                 730                 735
```

METHODS AND COMPOSITIONS FOR DUAL GLYCAN BINDING AAV2.5 VECTOR

STATEMENT OF PRIORITY

This patent application is a continuation under 35 U.S.C. § 111(a) of PCT Application No. PCT/US2021/056582, filed on Oct. 26, 2021, which claims the benefit, under 35 U.S.C. § 119(e), of U.S. Provisional Application No. 63/106,733, filed on Oct. 28, 2020, the entire contents of each of which are incorporated by reference herein.

STATEMENT OF GOVERNMENT SUPPORT

This invention was made with government support under Grant Numbers HL085794 and OD011107 awarded by the National Institutes of Health. The government has certain rights in the invention.

STATEMENT REGARDING ELECTRONIC FILING OF A SEQUENCE LISTING

A Sequence Listing in ASCII text format, submitted under 37 C.F.R. § 1.821, entitled 5470-891CT 3102023 ST25.txt, 13,109 bytes in size, generated on Mar. 10, 2023 and filed via EFS-Web, is provided in lieu of a paper copy. This Sequence Listing is hereby incorporated herein by reference into the specification for its disclosures.

FIELD OF THE INVENTION

The present invention relates to modified capsid proteins from adeno-associated virus (AAV), virus capsids and virus vectors comprising the same, as well as methods of their use.

BACKGROUND OF THE INVENTION

Inborn errors of metabolism are responsible for a group of diverse congenital diseases where a single gene produces a dysfunctional enzyme necessary for the development and maintenance of neurological function as well as neuronal survival. Unfortunately, many of these are quickly progressing neurodegenerative disorders that result in pre-mature death in the first or second decade of life. Loss-of-function mutations in these enzymatic genes typically follow autosomal recessive or X-linked modes of inheritance, which makes them attractive for simple gene replacement strategies. A major challenge to developing gene therapies for this group of diseases is that successful therapeutic intervention must occur very early in development because damage is potentially irreversible. Over the last two decades studies have consistently demonstrated that the greatest opportunity for success exists when intervening prior to initiation of the neurodegenerative process. For example, mucopolysaccharidosis (MPS) and leukodystrophies are rare pediatric neurodegenerative disorders that result from impaired metabolism of carbohydrate molecules or fatty acids, but are treatable by cellular therapies and enzyme replacement strategies. Several studies have demonstrated that intervention is unable to slow or reverse disease progression after behavioral or physical symptoms manifest. However, children who were asymptomatic at the time of treatment benefited most from the intervention and had the greatest odds of survival.

Clinically, onset of MPS and leukodystrophies is typically observed in infancy and early childhood with progressive central and peripheral nervous system involvement. Primary symptoms include the loss of fine and gross motor movements, sensory impairment, distal muscle weakness, and tendon contractures. Affected patients frequently become wheelchair-dependent, hearing and vision impaired, and these diseases are often fatal by 2-8 years of life. Genes known to be involved in leukodystrophies contain mutations in arylsulfatase A (ASA), responsible for metachromatic leukodystrophy; galactosylceramidase (GALC), responsible for Krabbe disease; aspartoacylase (ASPA), responsible for Canavan disease; and a peroxisomal ATP-binding cassette (ABCD1), responsible for X-linked adenoleukodystrophy. Adeno-associated viral (AAV) vectors provide an attractive option for efficient, targeted gene therapy because they are nonpathogenic with a strong safety profile in humans. Naturally occurring AAV serotypes have shown tropism for multiple tissues, and thus there is a need in the field for the development of methods to target AAV vectors to specifically desired target tissues with minimal off-target expression.

Virus-glycan interactions are critical determinants of host cell invasion. Cell surface carbohydrates such as sialic acids, gangliosides or heparan sulfate are exploited by a vast number of viruses such as influenza, herpesvirus, SV40, polyomavirus, papillomavirus and other pathogens. In most cases, a single class of glycans primarily serves as the cell surface attachment factor for viruses, leading to sequential or parallel engagement of other receptors/co-receptors for cell entry. Adeno-associated viruses (AAV) are helper-dependent parvoviruses that exploit heparan sulfate (HS), galactose (Gal) or sialic acids (Sia) as primary receptors for cell surface binding. For instance, AAV serotypes 2 and 3b utilize HS; AAV1, 4 and 5 bind Sia with different linkage specificities; while AAV9 exploits Gal for host cell attachment. Different AAV strains also require subsequent interaction with co-receptors such as integrin $\alpha V\beta 5$ or $\alpha 5\beta 1$, fibroblast growth factor receptor (FGFR), platelet-derived growth factor receptor (PDGFR), epidermal growth factor receptor (EGFR), hepatocyte growth factor receptor (HGFR), or the laminin receptor for cellular uptake.

A notable exception to the monogamous relationship between a specific AAV strain and a single class of carbohydrates is AAV serotype 6, which recognizes both Sia and HS. However, only Sia has been shown essential for viral transduction. The Sia binding footprints for AAV1, AAV4, AAV5 and AAV6 remain to be determined. More recently, key amino acid residues involved in Gal recognition by AAV9 capsids were identified by using a combination of molecular docking and site-directed mutagenesis. What is needed are virus vectors that have multiple glycan binding capability to exploit alternative pathways for cell entry and transduction.

The present invention overcomes previous shortcomings in the art by providing modified capsid proteins with multiple glycan binding sites, AAV vectors comprising these capsid proteins and methods for their use as therapeutic vectors in disorders such as neurodegenerative leukodystrophies and MPS.

SUMMARY OF THE INVENTION

Aspects of the invention relate to an adeno-associated virus (AAV) capsid protein that comprises an AAV2.5 capsid protein comprising one or more amino acid substitutions that introduce a new glycan binding site (e.g., which does not contain a substitution at the position corresponding to amino acid 267 of AAV2.5, or does not contain a serine at the position corresponding to amino acid 267 of AAV2.5). In one embodiment, the one or more amino acid substitutions do not include A267S (sometimes referred to herein as AAV2.5G9 A267).

In embodiments of the capsid proteins, capsids, viral vectors and methods described herein, the one or more amino acid substitutions comprise SQAGASDIRDQSR464-476SX$_1$AGX$_2$SX$_3$X$_4$X$_5$X$_6$QX$_7$R, wherein X$_{1-7}$ can be any amino acid, and EYSW500-503EX$_8$X$_9$W, wherein X$_{8-9}$ can be any amino acid.

In embodiments of the capsid proteins, capsids, viral vectors and methods described herein, X$_1$ is V or a conservative substitution thereof; X$_2$ is P or a conservative substitution thereof; X$_3$ is N or a conservative substitution thereof, X$_4$ is M or a conservative substitution thereof; X$_5$ is A or a conservative substitution thereof, X$_6$ is V or a conservative substitution thereof; X$_7$ is G or a conservative substitution thereof; X$_8$ is F or a conservative substitution thereof, and/or X$_9$ is A or a conservative substitution thereof.

In embodiments of the capsid proteins, capsids, viral vectors and methods described herein, X$_1$ is V, X$_2$ is P, X$_3$ is N, X$_4$ is M, X$_5$ is A, X$_6$ is V, X$_7$ is G, X$_8$ is F, and X$_9$ is A, wherein the new glycan binding site is a galactose binding site.

In embodiments of the capsid proteins, capsids, viral vectors and methods described herein, the amino acid sequence of the AAV2.5 capsid protein is SEQ ID NO:1 or a functional derivative thereof (e.g., which does not contain a substitution at the position corresponding to amino acid 267 of AAV2.5, or does not contain a serine at the position corresponding to amino acid 267 of AAV2.5).

In embodiments of the capsid proteins, capsids, viral vectors and methods described herein, the amino acid sequence of the capsid protein is SEQ ID NO:2 or a functional derivative thereof (e.g., which does not contain a substitution at the position corresponding to amino acid 267 of AAV2.5, or does not contain a serine at the position corresponding to amino acid 267 of AAV2.5).

Aspects of the invention relate to a viral capsid comprising the AAV capsid protein described above.

Aspects of the invention relate to a virus vector comprising the viral capsid described above and a nucleic acid comprising at least one terminal repeat sequence, wherein the nucleic acid is encapsidated by the viral capsid.

In some embodiments, the AAV2.5G9 described herein evades immune response elicited by pre-existing antibody e.g., antibodies recognizing AAVrh10 or antibodies recognizing other AAV serotypes except AAV2.5G9.

Aspects of the invention relate to a composition comprising the AAV capsid protein described above, the viral capsid described above, and/or the virus vector described above, in a pharmaceutically acceptable carrier.

Aspects of the invention relate to a method of introducing a nucleic acid into a cell, comprising contacting the cell with the virus vector described above (e.g., AAV2.5G9 comprising the capsid protein of SEQ ID NO:2 or a functional derivative thereof). In some embodiments of the methods described herein, the cell is in neural tissue. In some embodiments of the methods described herein, the cell is a neuron or a glial cell. In some embodiments of the methods described herein, the glial cell is an astrocyte. In some embodiments of the methods described herein, the virus vector has enhanced transduction of neural tissue as compared to an AAV1, AAV2, AAV9, or AAV2.5 virus vector. In some embodiments of the methods described herein the cell is in a subject. In some embodiments of the methods described herein the subject is a human subject. In some embodiments of the methods described herein the subject is a child. In some embodiments of the methods described herein the child is an infant. In some embodiments of the methods described herein the subject is in utero. In some embodiments of the methods described herein the subject has a reduced immunologic profile when contacted with the virus vector as compared to when contacted with an AAV1, AAV2, AAV9, or AAV2.5 virus vector.

In some embodiments, the AAV2.5G9 is used for repeat administration of a therapeutic in the method of introducing a nucleic acid into a cell in a subject (e.g., human, child, infant, in utero). In some embodiments, the AAV2.5G9 (e.g., comprising the capsid protein of SEQ ID NO:2 or a functional derivative thereof) is used for one administration in the method wherein, AAVrh10 is used for another administration. In some embodiments, the AAV2.5G9 (e.g., comprising the capsid protein of SEQ ID NO:2 or a functional derivative thereof) and other AAV vectors used for repeat administration in the method are used at a same viral titer. In some embodiments, AAV2.5G9 (e.g., comprising the capsid protein of SEQ ID NO:2 or a functional derivative thereof) and other AAV vectors used for repeat administration in the method are used at different viral titers.

Aspects of the invention relate to a method of treating a disease or disorder in a subject in need thereof, comprising introducing a therapeutic nucleic acid into a cell of the subject by administering to the subject the virus vector described herein and/or the composition described herein, under conditions whereby the therapeutic nucleic acid is expressed in the cell of the subject. In some embodiments of the methods described herein the subject is a human. In some embodiments of the methods described herein the subject is in utero. In some embodiments of the methods described herein the subject has or is at risk for a CNS disease or disorder. In some embodiments of the methods described herein the subject has or is at risk for a congenital neurodegenerative disorder. In some embodiments of the methods described herein the subject has or is at risk for adult-onset autosomal dominant leukodystrophy (ADLD), Aicardi-Goutieres syndrome, Alexander disease, CADASIL, Canavan disease, CARASIL, cerebrotendinous xanthomatosis childhood ataxia and cerebral hypomyelination (CACH)/vanishing white matter disease (VWMD), Fabry disease, fucosidosis, GM1 gangliosidosis, Krabbe disease, L-2-hydroxyglutaric aciduria megalencephalic leukoencephalopathy with subcortical cysts, metachromatic leukodystrophy, multiple sulfatase deficiency, Pelizaeus-Merzbacher disease, Pol III-Related Leukodystrophies, Refsum disease, salla disease (free sialic acid storage disease), Sjogren-Larsson syndrome, X-linked adrenoleukodystrophy, Zellweger syndrome spectrum disorders, Mucopolysaccharidosis Type I, Mucopolysaccharidosis Type II, Mucopolysaccharidosis Type III, Mucopolysaccharidosis Type IV, Mucopolysaccharidosis Type V, Mucopolysaccharidosis Type VI, Mucopolysaccharidosis Type VII, Mucopolysaccharidosis Type IX and any combination thereof. In some embodiments of the methods described herein the subject has or is at risk of having pain associated with a disease or disorder. In some embodiments of the methods described herein the virus vector or composition is delivered via an enteral, parenteral, intrathecal, intracisternal, intracerebral, intraventricular, intranasal, intra-aural, intra-ocular, peri-ocular, intrarectal, intramuscular, intraperitoneal, intravenous, oral, sublingual, subcutaneous and/or transdermal route. In some embodiments of the methods described herein the virus vector or composition is delivered intracranially and/or intraspinally.

In some embodiments, the AAV2.5G9 (e.g., comprising the capsid protein of SEQ ID NO:2 or a functional derivative thereof) is used in the method of treating a disease or disorder for repeat administration/dosing of the therapeutic (e.g., to a human, child, infant, in utero). In some embodiments, the AAV2.5G9 (e.g., comprising the capsid protein of SEQ ID NO:2 or a functional derivative thereof) is used for one administration wherein, AAVrh10 is used for another administration. In some embodiments, the AAV2.5G9 (e.g., comprising the capsid protein of SEQ ID NO:2 or a functional derivative thereof) and other AAV vectors used for repeat administration in the method are used at a same viral titer. In some embodiments, AAV2.5G9 (e.g., comprising the capsid protein of SEQ ID NO:2 or a functional derivative thereof) and other AAV vectors used for repeat administration in the method are used at different viral titers.

To the extent that any disclosure in PCT/US2020/029493 filed Apr. 23, 2020 falls within the invention as defined in any one or more of the claims of this application, or within any invention to be defined in amended claims that may in the future be filed in this application or in any patent derived therefrom, and to the extent that the laws of any relevant country or countries to which that or those claims apply provide that the disclosure of PCT/US2020/029493, filed Apr. 23, 2020, is part of the state of the art against that or those claims in or for that or those countries, we hereby reserve the right to disclaim the said disclosure from the claims of the present application or any patent derived therefrom to the extent necessary to prevent invalidation of the present application or any patent derived therefrom.

These and other aspects of the invention are addressed in more detail in the description of the invention set forth below.

Definitions

The singular forms "a," "an" and "the" are intended to include the plural forms as well, unless the context clearly indicates otherwise.

Furthermore, the term "about," as used herein when referring to a measurable value such as an amount of the length of a polynucleotide or polypeptide sequence, dose, time, temperature, and the like, is meant to encompass variations of ±20%, ±10%, ±5%, ±1%, ±0.5%, or even ±0.1% of the specified amount.

Also as used herein, "and/or" refers to and encompasses any and all possible combinations of one or more of the associated listed items, as well as the lack of combinations when interpreted in the alternative ("or").

Unless the context indicates otherwise, it is specifically intended that the various features of the invention described herein can be used in any combination.

Moreover, the present invention also contemplates that in some embodiments of the invention, any feature or combination of features set forth herein can be excluded or omitted.

To illustrate further, if, for example, the specification indicates that a particular amino acid can be selected from A, G, I, L and/or V, this language also indicates that the amino acid can be selected from any subset of these amino acid(s) for example A, G, I or L; A, G, I or V; A or G; only L; etc., as if each such subcombination is expressly set forth herein. Moreover, such language also indicates that one or more of the specified amino acids can be disclaimed. For example, in particular embodiments the amino acid is not A, G or I; is not A; is not G or V; etc., as if each such possible disclaimer is expressly set forth herein.

The term "tropism" as used herein refers to preferential entry of the virus or viral vector into certain cell or tissue types or preferential interaction with the cell surface that facilitates entry into certain cell or tissue types, optionally and preferably followed by expression (e.g., transcription and, optionally, translation) of sequences carried by the viral genome in the cell.

The term "target cell" is used to refer to a cell that is infected by the viral vector described herein. In some embodiments, the "target cell" may refer to a cell type that is infected by the virus/viral vector and in which the regulatory elements on the heterologous nucleic acid within promote expression.

The term "conservative substitution" or "conservative substitution mutation" as used herein refers to a mutation where an amino acid is substituted for another amino acid that has similar properties, such that one skilled in the art of peptide chemistry would expect the secondary structure, chemical properties, and/or hydropathic nature of the polypeptide to be substantially unchanged. The following groups of amino acids have been historically substituted for one another as conservative changes: (1) ala, pro, gly, glu, asp, gln, asn, ser, thr; (2) cys, ser, try, thr; (3) val, ile, leu, met, ala, phe; (4) lys, arg, his; and (5) phe, tyr, trp, his. Other commonly accepted conservative substitutions are listed below:

| Residue | Conservative Substitutions |
|---|---|
| Ala | Ser |
| Arg | Lys |
| Asn | Gln; His |
| Asp | Glu |
| Cys | Ser |
| Gln | Asn |
| Glu | Asp |
| Gly | Pro |
| His | Asn; Gln |
| Ile | Leu, Val |
| Leu | Ile; Val |
| Lys | Arg; Gln |
| Met | Leu; Ile |
| Phe | Met; Leu; Tyr |
| Ser | Thr; Gly |
| Thr | Ser; Val |
| Trp | Tyr |
| Tyr | Trp; Phe |
| Val | Ile; Leu |

As used herein, the terms "reduce," "reduces," "reduction" and similar terms mean a decrease of at least about 5%, 10%, 15%, 20%, 25%, 35%, 50%, 75%, 80%, 85%, 90%, 95%, 97%, 98%, 99%, 100% or more.

As used herein, the terms "enhance," "enhances," "enhancement" and similar terms indicate an increase of at least about 10%, 20%, 25%, 50%, 75%, 100%, 150%, 200%, 300%, 400%, 500% or more.

As used herein, the term "polypeptide" encompasses both peptides and proteins, unless indicated otherwise.

A "polynucleotide," "nucleic acid," or "nucleic acid molecule" as used herein is a sequence of nucleotide bases, and may be RNA, DNA or DNA-RNA hybrid sequences (including both naturally occurring and non-naturally occurring nucleotide), but in representative embodiments are either single or double stranded DNA sequences.

As used herein, an "isolated" polynucleotide (e.g., an "isolated DNA" or an "isolated RNA") means a polynucleotide at least partially separated from at least some of the other components of the naturally occurring organism or virus, for example, the cell or viral structural components or other polypeptides or nucleic acids commonly found associated with the polynucleotide. In representative embodiments an "isolated" nucleotide is enriched by at least about 10-fold, 100-fold, 1000-fold, 10,000-fold or more as compared with the starting material.

Likewise, an "isolated" polypeptide means a polypeptide that is at least partially separated from at least some of the other components of the naturally occurring organism or virus, for example, the cell or viral structural components or other polypeptides or nucleic acids commonly found associated with the polypeptide. In representative embodiments an "isolated" polypeptide is enriched by at least about 10-fold, 100-fold, 1000-fold, 10,000-fold or more as compared with the starting material.

As used herein, by "isolate" or "purify" (or grammatical equivalents) a virus vector, it is meant that the virus vector is at least partially separated from at least some of the other components in the starting material. In representative embodiments an "isolated" or "purified" virus vector is enriched by at least about 10-fold, 100-fold, 1000-fold, 10,000-fold or more as compared with the starting material.

A "therapeutic molecule" (e.g., a nucleic acid or polypeptide) is a molecule that can alleviate, reduce, prevent, delay and/or stabilize symptoms that result from an absence or defect in a protein in a cell or subject and/or is a molecule that otherwise confers a benefit to a subject. Such therapeutic molecules may be encoded by a heterologous nucleic acid present in the viral vector described herein, and under the regulatory sequences that promote expression of the nucleic acid.

By the terms "treat," "treating" or "treatment of" (and grammatical variations thereof) it is meant that the severity of the subject's condition is reduced, at least partially improved or stabilized and/or that some alleviation, mitigation, decrease or stabilization in at least one clinical symptom is achieved and/or there is a delay in the progression of the disease or disorder.

The terms "prevent," "preventing" and "prevention" (and grammatical variations thereof) refer to prevention and/or delay of the onset of a disease, disorder and/or a clinical symptom(s) in a subject and/or a reduction in the severity of the onset of the disease, disorder and/or clinical symptom(s) relative to what would occur in the absence of the methods of the invention. The prevention can be complete, e.g., the total absence of the disease, disorder and/or clinical symptom(s). The prevention can also be partial, such that the occurrence of the disease, disorder and/or clinical symptom(s) in the subject and/or the severity of onset is less than what would occur in the absence of the present invention.

A "treatment effective," "therapeutic," or "effective" amount as used herein is an amount that is sufficient to provide some improvement or benefit to the subject. Alternatively stated, a "treatment effective," "therapeutic," or "effective" amount is an amount that will provide some alleviation, mitigation, decrease or stabilization in at least one clinical symptom in the subject. Those skilled in the art will appreciate that the therapeutic effects need not be complete or curative, as long as some benefit is provided to the subject.

A "prevention effective" amount as used herein is an amount that is sufficient to prevent and/or delay the onset of a disease, disorder and/or clinical symptoms in a subject and/or to reduce and/or delay the severity of the onset of a disease, disorder and/or clinical symptoms in a subject relative to what would occur in the absence of the methods of the invention. Those skilled in the art will appreciate that the level of prevention need not be complete, as long as some benefit is provided to the subject.

The terms "heterologous nucleotide sequence," "heterologous nucleic acid," or "heterologous nucleic acid molecule" are used interchangeably herein and refer to a sequence that is not naturally occurring in the virus. Generally, the heterologous nucleic acid comprises an open reading frame that encodes a polypeptide or nontranslated RNA of interest (e.g., for delivery to a cell or subject) such as a therapeutic or diagnostic molecule.

As used herein, the terms "virus vector," "vector" or "gene delivery vector" refer to a virus (e.g., AAV) particle that functions as a nucleic acid delivery vehicle, and which comprises the vector genome (e.g., viral DNA [vDNA]) packaged within a virion. Alternatively, in some contexts, the term "vector" may be used to refer to the vector genome/vDNA alone.

As used herein when referring to viruses, the terms "vector," "particle," and "virion" may be used interchangeably.

The virus vectors of the invention can further be "targeted" virus vectors (e.g., having a directed tropism) and/or a "hybrid" parvovirus (i.e., in which the viral TRs and viral capsid are from different parvoviruses), e.g., as described in international patent publication WO 00/28004, the disclosure of which is incorporated herein by reference in its entirety.

The virus vectors of the invention can further be duplexed parvovirus particles as described in international patent publication WO 01/92551 (the disclosure of which is incorporated herein by reference in its entirety). Thus, in some embodiments, double stranded (duplex) genomes can be packaged into the virus capsids of the invention.

DETAILED DESCRIPTION OF THE INVENTION

Figure 1:
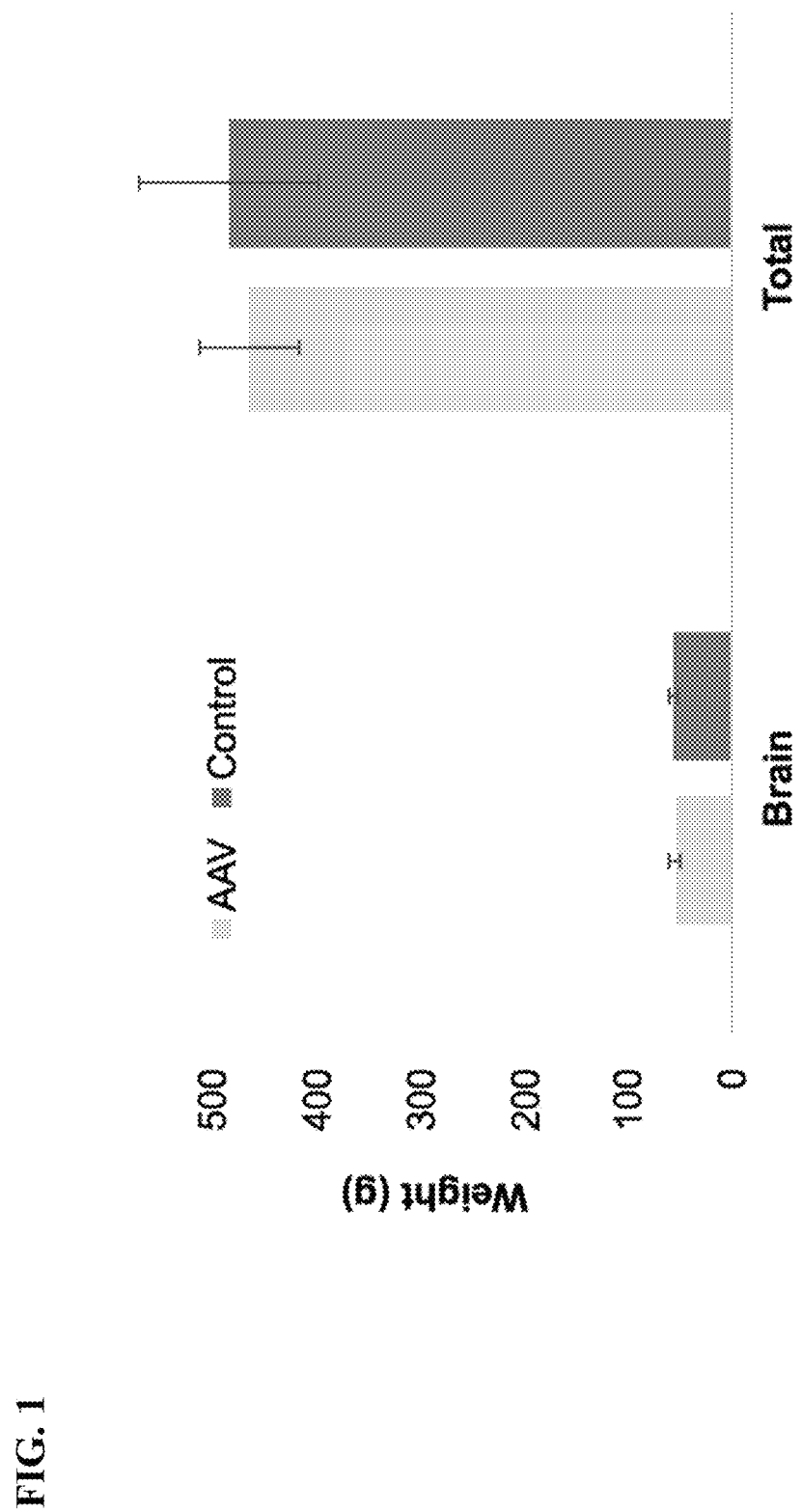
FIG. 1 shows effects of AAV administration on weight. Fetal brain and body weights of AAV-treated (combined AAV9, AAV2G9, and AAV2.5G9; N=9) and control fetuses (N=36) were compared. No significant differences were observed between the groups (p<0.05). Data are shown as mean±standard error of the mean. Significance was determined by Student's t-test analysis at p≤0.05.

The present invention will now be described with reference to the accompanying drawings, in which representative embodiments of the invention are shown. This invention may, however, be embodied in different forms and should not be construed as limited to the embodiments set forth herein. Rather, these embodiments are provided so that this disclosure will be thorough and complete, and will fully convey the scope of the invention to those skilled in the art.

Unless otherwise defined, all technical and scientific terms used herein have the same meaning as commonly understood by one of ordinary skill in the art to which this invention belongs. The terminology used in the description of the invention herein is for the purpose of describing particular embodiments only and is not intended to be limiting of the invention. All publications, patent applications, patents, and other references mentioned herein are incorporated by reference herein in their entirety.

To the extent that any disclosure in PCT/US2020/029493 filed Apr. 23, 2020 falls within the invention as defined in any one or more of the claims of this application, or within any invention to be defined in amended claims that may in the future be filed in this application or in any patent derived therefrom, and to the extent that the laws of any relevant country or countries to which that or those claims apply provide that the disclosure of PCT/US2020/029493 is part of the state of the art against that or those claims in or for that or those countries, we hereby reserve the right to disclaim the said disclosure from the claims of the present application or any patent derived therefrom to the extent necessary to prevent invalidation of the present application or any patent derived therefrom.

Aspects of the invention relate to the discovery of a "pocket" on the AAV capsid protein that defines a glycan recognition footprint and the grafting of such a recognition footprint onto a heterologous capsid protein to thereby produce a novel AAV capsid protein. Specific amino acids that define this pocket have been identified and are described herein, for example for the galactose binding site of AAV9. Thus the present invention is directed to molecular grafting of a new glycan recognition footprint (e.g., that of a donor AAV strain capsid) onto a capsid protein to thereby modify the capsid protein. Such grafting is guided by structural modeling studies and achieved by site-directed mutagenesis. Recombinant vectors (having capsids derived from such grafting) carrying transgenes (e.g., reporter cassettes) display rapid onset and enhanced transgene expression in cell culture and animal models. Viral vectors generated from this strategy can address challenges such as dose-dependent immunotoxicity observed in human gene therapy clinical trials.

In some embodiments, the substitutions introduce a glycan binding site from a capsid protein of a first AAV serotype ("donor") into the capsid protein of a second AAV serotype ("template") that is different from said first AAV serotype. Thus, in one aspect, the present invention relates to an adeno-associated virus (AAV) capsid protein, which comprises an AAV2.5 capsid comprising one or more amino acids substitutions, wherein the substitutions introduce a glycan binding site into the AAV capsid protein, to thereby produce a "modified capsid protein," or a "modified AAV2.5 capsid protein."

In some embodiments, the glycan binding site can be a hexose binding site, wherein the hexose is a galactose (Gal), a mannose (Man), a glucose (Glu) or a fucose (fuc). In some embodiments, the glycan binding site can be a sialic acid (Sia) binding site, wherein the Sia residue is N-acetylneuraminic acid (Neu5Ac) or N-Glycolylneuraminic acid (Neu5Gc). In some embodiments, the glycan binding site can be a disaccharide binding site, wherein the disaccharide is a sialic acid linked to galactose in the form Sia(alpha2, 3)Gal or Sia(alpha2,6)Gal.

In some embodiments, the glycan binding site is a galactose binding site. In some embodiments, the AAV9 galactose binding site (donor) is grafted into an AAV2.5 capsid protein template, resulting in the introduction of a new glycan binding site in the engrafted (modified) AAV2.5 capsid protein template. The new glycan binding site is generated by the introduction of one or more amino acid substitutions into the AAV2.5 capsid template.

Immunogenicity of a given AAV virus can be altered from even a slight change in amino acid sequence (e.g., of the capsid protein). In this way, the neutralizing antibody response of a subject exposed to a given AAV vector therapeutic can also differ dramatically to that of the same AAV vector therapeutic with altered amino acid sequence. Generally, mutants that have few amino acid substitutions are preferred for immunological reasons, as few mutations will lead to fewer reactive antibodies. In some instances, the ability to generate capsid mutants from different amino acid substitutions and/or insertions that exhibit the same phenotype will also allow the physician to draw on a plurality of such rationally designed viral vectors. This would be advantageous in reducing the impact of pre-existing neutralizing antibodies on the administered therapeutic, and could permit repeated therapeutic administration using the different vectors.

In some embodiments, AAV2.5G9 evades immune response elicited by pre-existing antibodies e.g., antibodies recognizing AAVrh10 or antibodies recognizing other AAV serotypes except AAV2.5G9. In some embodiments, the pre-existing antibodies are neutralizing antibodies. In some embodiments, AAV2.5G9 is used for repeat administration of a therapeutic. In some embodiments, AAV2.5G9 is used for one administration wherein, AAVrh10 is used for the other administration. In some embodiments, AAV2.5G9 and other AAV vectors used for repeat administration are used at a same viral titer. In some embodiments, AAV2.5G9 and other AAV vectors used for repeat administration are used at different viral titers.

In some embodiments, the amino acid substitutions comprise:
a) SQAGASDIRDQSR464-476SX$_1$AGX$_2$SX$_3$X$_4$X$_5$X$_6$QX$_7$R, wherein X$_{1-7}$ can be any amino acid; and b) EYSW500-503EX$_8$X$_9$W, wherein X$_{8-9}$ can be any amino acid. In some embodiments, the resulting modified AAV2.5 capsid protein does not contain a substitution at position 267. In some embodiments, the resulting modified AAV2.5 capsid protein does not contain a substitution of serine for alanine at position 267.

In some embodiments, the amino acid substitutions are in amino acids 464-476, and/or amino acids 500-503 in AAV2.5 (SEQ ID NO:1; VP1 numbering).

In some embodiments, X$_1$ is V or a conservative substitution thereof, X$_2$ is P or a conservative substitution thereof, X$_3$ is N or a conservative substitution thereof, X$_4$ is M or a conservative substitution thereof, X$_5$ is A or a conservative substitution thereof, X$_6$ is V or a conservative substitution thereof, X$_7$ is G or a conservative substitution thereof, X$_8$ is F or a conservative substitution thereof, and/or X$_9$ is A or a conservative substitution thereof.

In some embodiments, X$_1$ is V, X$_2$ is P, X$_3$ is N, X$_4$ is M, X$_5$ is A, X$_6$ is V, X$_7$ is G, X$_8$ is F, and X$_9$ is A, to thereby result in a new glycan binding site that is a galactose binding site.

The AAV2.5 capsid template may have the amino acid sequence of SEQ ID NO: 1, or a functional derivative thereof. A functional derivative of an amino acid sequence may have an amino acid substitution, insertion or deletion, which substantially preserves one or more properties or functions of the original sequence. In some embodiments, the functional derivative does not contain a substitution at the position corresponding to amino acid 267 of AAV2.5. In some embodiments, the functional derivative does not contain a serine substitution at the position corresponding to amino acid 267 of AAV2.5.

Functional derivatives have amino acid substitutions, insertions and/or deletions that do not substantially affect protein function such as the derivatives will retain one or more activities (properties or functions) when compared to that of the original protein (e.g., SEQ ID NO:1). Such derivatives will retain at least 50%, 55%, 60%, 65%, 70%, 75%, 80%, 85%, 90%, 95%, 96%, 97%, 98% 99% or be indistinguishable (not significantly different) with respect to one or more activities of the original protein. Such activities include, without limitation, one or more cell type and/or tissue tropism.

In some embodiments, the functional derivative results from one or more conservative amino acid substitutions of SEQ ID NO:1. Examples of conservative amino acid substitutions are provided herein. In some embodiments, the functional derivative does not contain a substitution at the position corresponding to amino acid 267 of AAV2.5. In some embodiments, the functional derivative does not contain a serine substitution at the position corresponding to amino acid 267 of AAV2.5.

In some embodiments, the AAV capsid protein template/backbone is from AAV2.5 (SEQ ID NO:1; VP1 numbering), and the amino acid substitutions are a Q465V substitution, an A468P substitution, a D470N substitution, an I471M substitution, an R472A substation, a D473V substitution, an S475G substitution, a Y501F substitution, and/or an S502A substitution, in any combination. Thus, in some embodiments, the present invention provides an AAV2.5 capsid protein, comprising an AAV capsid protein backbone from AAV2.5 (SEQ ID NO:1; VP1 numbering) comprising a Q465V substitution, an A468P substitution, a D470N substitution, an I471M substitution, an R472A substitution, a D473V substitution, an S475G substitution, a Y501F substitution, and an S502A substitution, wherein the substitutions introduce a glycan binding site into the AAV2.5 capsid protein. In some embodiments, the AAV2.5 capsid protein does not contain a substitution at the position corresponding to amino acid 267 of AAV2.5, and/or does not contain a serine substitution at the position corresponding to amino acid 267 of AAV2.5.

The AAV2.5 capsid protein that serves as the template originated from specific mutations to the AAV2 capsid sequences as described in U.S. Pat. No. 9,012,224, the contents of which are incorporated herein by reference. This was generated by changing 5 amino acids in AAV2 to resemble AAV1 at those specific locations (Q263A; 265insT; N705A; V708A; T716N). The resulting amino acid modifications are shown in the below sequences (SEQ ID NO:1) as capital letters. The properties conferred to a viral particle from the resulting AAV2.5 capsid protein are well characterized (U.S. Pat. No. 9,012,224). Without limitation, the properties the AAV2.5 capsid confers to a viral particle include, enhanced skeletal muscle tropism, reduced liver-hepatocyte tropism as compared to AAV2, neural tropism, and glial tropism (e.g., astrocytes), as well as the ability to escape neutralization from existing AAV2 and AAV1 neutralizing antibodies. In some embodiments of the invention described herein, the amino acid sequence of the AAV2.5 capsid protein is that shown in SEQ ID NO:1, which utilizes VP1 numbering. In some embodiments, the AAV2.5 capsid protein is a functional derivative of the capsid protein having the amino acid sequence of SEQ ID NO:1. In some embodiments, the functional derivative does not contain a substitution at the position corresponding to amino acid 267 of AAV2.5, and/or does not contain a serine substitution at the position corresponding to amino acid 267 of AAV2.5.

AAV2.5 capsid protein

SEQ ID NO: 1

```
  1 maadgylpdw ledtlsegir qwwklkpgpp ppkpaerhkd
    dsrglvlpgy kylgpfngld 61 kgepvneada aalehdkayd rqldsgdnpy lkynhadaef
    qerlkedtsf ggnlgravfq 121 akkrvleplg lveepvktap gkkrpvehsp vepdsssgtg
    kagqqparkr lnfgqtgdad 181 svpdpqplgq ppaapsglgt ntmatgsgap madnnegadg
    vgnssgnwhc dstwmgdrvi 241 ttstrtwalp tynnhlykqi ssAsTgasnd nhyfgystpw
    gyfdfnrfhc hfsprdwqrl 301 innnwgfrpk rlnfklfniq vkevtqndgt ttiannltst
    vqvftdseyq lpyvlgsahq 361 gclppfpadv fmvpqygylt lnngsqavgr ssfycleyfp
    sqmlrtgnnf tfsytfedvp 421 fhssyahsqs ldrlmnplid qylyylsrtn tpsgtttqsr
    lqfsqagasd irdqsrnwlp 481 gpcyrqqrvs ktsadnnnse yswtgatkyh lngrdslvnp
    gpamashkdd eekffpqsgv 541 lifgkqgsek tnvdiekvmi tdeeeirttn pvateqygsv
    stnlqrgnrq aatadvntqg 601 vlpgmvwqdr dvylqgpiwa kiphtdghfh psplmggfgl
    khpppqilik ntpvpanpst 661 tfsaakfasf itqystgqvs veiewelqke nskrwnpeiq
    ytsnyAksAn vdftvdNngv 721 eprpigtr yltrnl (AAV2.5).
```

In some embodiments, the AAV2.5 capsid has an amino acid sequence that is at least about 70%, 75%, 80%, 85%, 90%, 95%, 97%, 98% or 99% similar or identical to that shown in SEQ ID NO: 1. In some embodiments, the AAV2.5 capsid protein does not contain a substitution at the position corresponding to amino acid 267 of AAV2.5, and/or does not contain a serine substitution at the position corresponding to amino acid 267 of AAV2.5.

For example, in particular embodiments, an "AAV2.5" capsid protein encompasses the amino acid sequence shown in SEQ ID NO:1, as well as sequences that are at least about 75%, 80%, 85%, 90%, 95%, 97%, 98% or 99% similar or identical to the amino acid sequence of SEQ ID NO: 1, wherein the AAV2.5 capsid protein does not contain a substitution at the position corresponding to amino acid 267 of AAV2.5, and/or does not contain a serine substitution at the position corresponding to amino acid 267 of AAV2.5.

Methods of determining sequence similarity or identity between two or more amino acid sequences are known in the art. Sequence similarity or identity may be determined using standard techniques known in the art, including, but not limited to, the local sequence identity algorithm of Smith & Waterman. *Adv. Appl. Math.* 2:482 (1981), by the sequence identity alignment algorithm of Needleman & Wunsch. *J. Mol. Biol.* 48:443 (1970), by the search for similarity method of Pearson & Lipman. *Proc. Natl. Acad. Sci. USA* 85:2444 (1988), by computerized implementations of these algorithms (GAP, BESTFIT, FASTA, and TFASTA in the Wisconsin Genetics Software Package, Genetics Computer Group, 575 Science Drive, Madison, Wis.), the Best Fit sequence program described by Devereux et al. *Nucl. Acid Res.* 12:387-395 (1984), or by inspection.

Another suitable algorithm is the BLAST algorithm, described in Altschul et al. *J. Mol. Biol.* 215:403-410 (1990) and Karlin et al. *Proc. Natl. Acad. Sci. USA* 90:5873-5787 (1993). A particularly useful BLAST program is the WU-BLAST-2 program which was obtained from Altschul et al. *Methods in Enzymology* 266:460-480 (1996); blast.wustl/edu/blast/README.html. WU-BLAST-2 uses several search parameters, which are optionally set to the default values. The parameters are dynamic values and are established by the program itself depending upon the composition of the particular sequence and composition of the particular database against which the sequence of interest is being searched; however, the values may be adjusted to increase sensitivity.

Further, an additional useful algorithm is gapped BLAST as reported by Altschul et al. *Nucleic Acids Res.* 25:3389-3402 (1997).

In some embodiments, a modified AAV capsid protein of the present invention has the amino acid sequence shown in SEQ ID NO:2, or is a functional derivative thereof, (e.g., wherein the AAV2.5 capsid protein does not contain a substitution at the position corresponding to amino acid 267 of AAV2.5, and/or does not contain a serine substitution at the position corresponding to amino acid 267 of AAV2.5).

In some embodiments, the modified AAV capsid protein comprises, consists essentially of, or consists of the nucleotide sequence of SEQ ID NO:2 or a nucleotide sequence at least about 70% identical thereto, e.g., at least about 70, 75, 80, 85, 90, 91, 92, 93, 94, 95, 96, 97, 98, or 99% identical thereto (e.g., wherein the AAV2.5 capsid protein does not contain a substitution at the position corresponding to amino acid 267 of AAV2.5, and/or does not contain a serine substitution at the position corresponding to amino acid 267 of AAV2.5).

```
AAV2.5G9 A267 capsid protein
                                              SEQ ID NO: 2
  1 maadgylpdw ledtlsegir qwwklkpgpp ppkpaerhkd
    dsrglvlpgy kylgpfngld 61 kgepvneada aalehdkayd rqldsgdnpy lkynhadaef
    qerlkedtsf ggnlgravfq 121 akkrvleplg lveepvktap gkkrpvehsp vepdsssgtg
    kagqqparkr lnfgqtgdad 181 svpdpqplgq ppaapsglgt ntmatgsgap madnnegadg
    vgnssgnwhc dstwmgdrvi 241 ttstrtwalp tynnhlykqi ssAsTgasnd nhyfgystpw
    gyfdfnrfhc hfsprdwqrl 301 innnwgfrpk rlnfklfniq vkevtqndgt ttiannltst
    vqvftdseyq lpyvlgsahq 361 gclppfpadv fmvpqygylt lnngsqavgr ssfycleyfp
    sqmlrtgnnf tfsytfedvp 421 fhssyahsqs ldrlmnplid qylyylsrtn tpsgtttqsr
    lqfSVAGPSN MAVQGRnwlp 481 gpcyrqqrvs ktsadnnnsE FAWtgatkyh lngrdslvnp
    gpamashkdd eekffpqsgv 541 lifgkqgsek tnvdiekvmi tdeeeirttn pvateqygsv
    stnlqrgnrq aatadvntqg 601 vlpgmvwqdr dvylqgpiwa kiphtdghfh psplmggfgl
    khpppqilik ntpvpanpst
```

-continued

```
661 tfsaakfasf itqystgqvs veiewelqke nskrwnpeiq
    ytsnyAksAn vdftvdNngv 721 yseprpigtr yltrnl (AAV2.5G9 A267).
```

The examples provided herein indicate possible amino acid substitutions in an AAV2.5 template for introduction of a galactose binding site from an AAV9 donor. These examples, which are not intended to be limiting, demonstrate the principle that a glycan binding site from a donor AAV serotype can be introduced into a capsid protein template of a different AAV serotype by modifying residues the define the "pocket" described herein.

Such modified or chimeric capsid proteins comprising a new glycan binding site can be assembled into capsids that make up virus particles that can be used as virus vectors that have the beneficial phenotype of increased cell surface binding and more rapid and enhanced transgene expression in vivo.

Table 2 lists non-limiting exemplary serotypes of AAV and accession numbers of the genome and capsid sequences that may be encompassed by the invention. The AAV serotype of the donor and the template is not limited to human AAV, but may include non-human AAV, for example, Avian or Bovine AAV, as well as non-human primate AAV, examples of which are shown in Table 1. As used herein, the term "adeno-associated virus" (AAV), includes but is not limited to, AAV type 1, AAV type 2, AAV type 2.5, AAV type 3 (including types 3A and 3B), AAV type 4, AAV type 5, AAV type 6, AAV type 7, AAV type 8, AAV type 9, AAV type 10, AAV type 11, avian AAV, bovine AAV, canine AAV, equine AAV, ovine AAV, Clade F AAV and any other AAV now known or later discovered. See, e.g., BERNARD N. FIELDS et al. VIROLOGY, Volume 2, Chapter 69 (4th ed., Lippincott-Raven Publishers). A number of relatively new AAV serotypes and clades have been identified (see Table 1).

The genomic sequences of various serotypes of AAV, as well as the sequences of the native terminal repeats (TRs), Rep proteins, and capsid subunits are known in the art. Exemplary but non-limiting examples of such sequences may be found in the literature or in public databases such as GenBank® Database. See, e.g., GenBank® Database Accession Numbers NC_002077.1, NC_001401.2, NC_001729.1, NC_001863.1, NC_001829.1, NC_006152.1, NC_001862.1, AF513851.1, AF513852.1, the disclosures of which are incorporated by reference herein for teaching parvovirus and AAV nucleic acid and amino acid sequences. See also, e.g., Srivistava et al. *J. Virology* 45:555 (1983); Chiorini et al. *J. Virology* 71:6823 (1998); Chiorini et al. *J. Virology* 73:1309 (1999); Bantel-Schaal et al. *J. Virology* 73:939 (1999); Xiao et al. *J. Virology* 73:3994 (1999); Muramatsu et al. *Virology* 221:208 (1996); Shade et al. *J. Virol.* 58:921 (1986); Gao et al. (2002) *Proc. Nat. Acad. Sci. USA* 99:11854 (2002); International Patent Publications WO 00/28061, WO 99/6160 and WO 98/11244; and U.S. Pat. No. 6,156,303; the disclosures of which are incorporated by reference herein for teaching parvovirus and AAV nucleic acid and amino acid sequences.

The capsid structures of autonomous parvoviruses and AAV are described in more detail in BERNARD N. FIELDS et al. VIROLOGY, Volume 2, Chapters 69 & 70 (4th ed., Lippincott-Raven Publishers). See also, description of the crystal structure of AAV2 (Xie et al. *Proc. Nat. Acad. Sci.* 99:10405-10 (2002)), AAV4 (Padron et al. *J. Virol.* 79: 5047-58 (2005)), AAV5 (Walters et al. *J. Virol.* 78: 3361-71 (2004)) and CPV (Xie et al. *J. Mol. Biol.* 6:497-520 (1996) and Tsao et al. *Science* 251: 1456-64 (1991)).

Other aspects of the invention relate to a capsid comprising the modified AAV capsid protein of the invention, e.g., wherein the modified AAV2.5 capsid protein does not contain a substitution at the position corresponding to amino acid 267 of AAV2.5, and/or does not contain a serine substitution at the position corresponding to amino acid 267 of AAV2.5.

Other aspects of the invention relate to a virus vector or particle comprising (a) the modified AAV capsid of the invention (e.g., wherein the modified AAV2.5 capsid protein does not contain a substitution at the position corresponding to amino acid 267 of AAV2.5, and/or does not contain a serine substitution at the position corresponding to amino acid 267 of AAV2.5); and (b) a nucleic acid comprising at least one terminal repeat sequence, wherein the nucleic acid is encapsidated by the capsid.

Another aspect of the invention relates to a composition comprising the modified AAV2.5 capsid protein, and/or the AAV capsid and/or virus vector comprising the modified AAV2.5 capsid protein, in a pharmaceutically acceptable carrier (e.g. wherein the modified AAV2.5 capsid protein does not contain a substitution at the position corresponding to amino acid 267 of AAV2.5, and/or does not contain a serine substitution at the position corresponding to amino acid 267 of AAV2.5).

The present invention additionally provides a method of introducing a nucleic acid into a cell, comprising contacting the cell with a virus vector comprising the modified AAV2.5 capsid protein (e.g., wherein the modified AAV2.5 capsid protein does not contain a substitution at the position corresponding to amino acid 267 of AAV2.5, and/or does not contain a serine substitution at the position corresponding to amino acid 267 of AAV2.5). The cell can be in a subject and in some embodiments, the subject can be a human subject. In some embodiments, the subject may be in utero. In some embodiments, the cell may be a neural cell (e.g., a neuronal cell or a glial cell, e.g., a cell of neuronal tissue). In some embodiments, the resultant virus vectors have enhanced transduction (e.g., enhanced levels of nucleic acid expression in) a cell (e.g., a neural cell, e.g., a neuronal cell) when contacted to the cell as compared to transduction levels of virus vectors of the donor and template serotypes when contacted to the cell. For example, if the AAV capsid protein donor is AAV serotype 9 and the AAV capsid protein template is AAV serotype 2.5 (AAV2.5), the resulting virus vector would be compared to AAV1, AAV2, AAV9, or AAV2.5.

Methods of Producing Virus Vectors

The invention also encompasses virus vectors comprising the modified capsid proteins and capsids of the invention. In particular embodiments, the virus vector is a parvovirus vector (e.g., comprising a parvovirus capsid and/or vector genome), for example, an AAV vector (e.g., comprising a AAV capsid and/or vector genome). In representative embodiments, the virus vector comprises a modified AAV capsid comprising a modified capsid protein subunit of the invention and a vector genome.

For example, in representative embodiments, the virus vector comprises: (a) a modified virus capsid (e.g., a modified AAV capsid) comprising a modified capsid protein of the invention; and (b) a nucleic acid comprising a terminal repeat sequence (e.g., an AAV TR), wherein the nucleic acid comprising the terminal repeat sequence is encapsidated by the modified virus capsid. The nucleic acid can optionally comprise two terminal repeats (e.g., two AAV TRs).

In representative embodiments, the virus vector is a recombinant virus vector wherein the genome of the virus comprises a heterologous nucleic acid of interest. The heterologous nucleic acid may encode a polypeptide or functional RNA of interest. Recombinant virus vectors are described in more detail below. The heterologous nucleic acid can be operably linked to appropriate control sequences to promote expression in the target cell. For example, the heterologous nucleic acid can be operably associated with expression control elements, such as transcription/translation control signals, origins of replication, polyadenylation signals, internal ribosome entry sites (IRES), promoters, and/or enhancers, and the like.

In particular embodiments, the virus vectors of the invention have altered (e.g., reduced) transduction of liver as compared with the level of transduction by a virus vector without the modified capsid protein (e.g., as compared to a virus vector with AAV2.5 capsid protein). In particular embodiments, the virus vector has systemic transduction toward muscle, e.g., the vector transduces multiple skeletal muscle groups throughout the body and optionally transduces cardiac muscle and/or diaphragm muscle. In some embodiments, the virus vectors of the invention have enhanced transduction (e.g., enhanced levels of nucleic acid expression in) neural (e.g., neuronal, glial such as astrocyte or oligodendrocyte) tissue, as compared to an appropriate control (e.g., as compared to other tissues, and/or as compared to transduction levels with other virus vectors, for example, a vector without the modified capsid protein, e.g., AAV1, AAV2, AAV9, AAV2.5, or any AAV serotype as listed in Table 1). An appropriate control may be an otherwise identical viral vector that has not received the grafted glycan binding site.

In some embodiments, the AAV2.5G9 exhibits substantially increased (e.g., over 10×, 20×, 30×, 40×, 50×, 60×, 70×, 80×, 90×, or over 100×) transduction in a given cell type as compared to AAVrh10. For example, the AAV2.5G9 may exhibit from over 10× to over 100× transduction in Human skin fibroblast GM16095 cells as compared to AAVrh10 as measured by Relative Luciferase unit RLU Luc. The AAV2.5G9 may exhibit from over 10× to over 100× transduction in neuronal cells or glial cells (such as astrocyte or oligodendrocyte) as compared to AAVrh10 as measured by Relative Luciferase unit RLU Luc.

It will be understood by those skilled in the art that the modified capsid proteins, virus capsids and virus vectors of the invention exclude those capsid proteins, capsids and virus vectors that have the indicated amino acids at the specified positions in their native state (i.e., are not "modified" with the substitutions described herein that introduce a glycan binding site).

The present invention further provides methods of producing the inventive virus vectors. In one representative embodiment, the present invention provides a method of producing a virus vector, the method comprising providing to a cell: (a) a nucleic acid template comprising at least one TR sequence (e.g., AAV TR sequence), and (b) AAV sequences sufficient for replication of the nucleic acid template and encapsidation into AAV capsids (e.g., AAV rep sequences and AAV cap sequences encoding the AAV capsids of the invention). Optionally, the nucleic acid template further comprises at least one heterologous nucleic acid sequence. In particular embodiments, the nucleic acid template comprises two AAV ITR sequences, which are located 5' and 3' to the heterologous nucleic acid sequence (if present), although they need not be directly contiguous thereto.

The nucleic acid template and AAV rep and cap sequences are provided under conditions such that virus vector comprising the nucleic acid template packaged within the AAV capsid is produced in the cell. The method can further comprise the step of collecting the virus vector from the cell. The virus vector can be collected from the medium and/or by lysing the cells.

The cell can be a cell that is permissive for AAV viral replication. Any suitable cell known in the art may be employed. In particular embodiments, the cell is a mammalian cell. As another option, the cell can be a trans-complementing packaging cell line that provides functions deleted from a replication-defective helper virus, e.g., 293 cells or other E1a trans-complementing cells.

The AAV replication and capsid sequences may be provided by any method known in the art. Current protocols typically express the AAV rep/cap genes on a single plasmid. The AAV replication and packaging sequences need not be provided together, although it may be convenient to do so. The AAV rep and/or cap sequences may be provided by any viral or non-viral vector. For example, the rep/cap sequences may be provided by a hybrid adenovirus or herpesvirus vector (e.g., inserted into the E1a or E3 regions of a deleted adenovirus vector). EBV vectors may also be employed to express the AAV cap and rep genes. One advantage of this method is that EBV vectors are episomal, yet will maintain a high copy number throughout successive cell divisions (i.e., are stably integrated into the cell as extra-chromosomal elements, designated as an "EBV based nuclear episome."

As a further alternative, the rep/cap sequences may be stably incorporated into a cell.

Typically the AAV rep/cap sequences will not be flanked by the TRs, to prevent rescue and/or packaging of these sequences.

The nucleic acid template can be provided to the cell using any method known in the art. For example, the template can be supplied by a non-viral (e.g., plasmid) or viral vector. In particular embodiments, the nucleic acid template is supplied by a herpesvirus or adenovirus vector (e.g., inserted into the E1a or E3 regions of a deleted adenovirus). As another example, a baculovirus vector carrying a reporter gene flanked by the AAV TRs can be used. EBV vectors may also be employed to deliver the template, as described above with respect to the rep/cap genes.

In another representative embodiment, the nucleic acid template is provided by a replicating rAAV virus. In still other embodiments, an AAV provirus comprising the nucleic acid template is stably integrated into the chromosome of the cell.

To enhance virus titers, helper virus functions (e.g., adenovirus or herpesvirus) that promote a productive AAV infection can be provided to the cell. Helper virus sequences necessary for AAV replication are known in the art. Typically, these sequences will be provided by a helper adenovirus or herpesvirus vector. Alternatively, the adenovirus or herpesvirus sequences can be provided by another non-viral or viral vector, e.g., as a non-infectious adenovirus miniplasmid that carries all of the helper genes that promote efficient AAV production.

Further, the helper virus functions may be provided by a packaging cell with the helper sequences embedded in the chromosome or maintained as a stable extrachromosomal element. Generally, the helper virus sequences cannot be packaged into AAV virions, e.g., are not flanked by TRs.

Those skilled in the art will appreciate that it may be advantageous to provide the AAV replication and capsid sequences and the helper virus sequences (e.g., adenovirus sequences) on a single helper construct. This helper construct may be a non-viral or viral construct. As one nonlimiting illustration, the helper construct can be a hybrid adenovirus or hybrid herpesvirus comprising the AAV rep/cap genes.

In one particular embodiment, the AAV rep/cap sequences and the adenovirus helper sequences are supplied by a single adenovirus helper vector. This vector can further comprise the nucleic acid template. The AAV rep/cap sequences and/or the rAAV template can be inserted into a deleted region (e.g., the E1a or E3 regions) of the adenovirus.

In a further embodiment, the AAV rep/cap sequences and the adenovirus helper sequences are supplied by a single adenovirus helper vector. According to this embodiment, the rAAV template can be provided as a plasmid template.

In another illustrative embodiment, the AAV rep/cap sequences and adenovirus helper sequences are provided by a single adenovirus helper vector, and the rAAV template is integrated into the cell as a provirus. Alternatively, the rAAV template is provided by an EBV vector that is maintained within the cell as an extrachromosomal element (e.g., as an EBV based nuclear episome).

In a further exemplary embodiment, the AAV rep/cap sequences and adenovirus helper sequences are provided by a single adenovirus helper. The rAAV template can be provided as a separate replicating viral vector. For example, the rAAV template can be provided by a rAAV particle or a second recombinant adenovirus particle.

According to the foregoing methods, the hybrid adenovirus vector typically comprises the adenovirus 5' and 3' cis sequences sufficient for adenovirus replication and packaging (i.e., the adenovirus terminal repeats and PAC sequence). The AAV rep/cap sequences and, if present, the rAAV template are embedded in the adenovirus backbone and are flanked by the 5' and 3' cis sequences, so that these sequences may be packaged into adenovirus capsids. As described above, the adenovirus helper sequences and the AAV rep/cap sequences are generally not flanked by TRs so that these sequences are not packaged into the AAV virions.

Zhang et al. (*Gene Ther.* 18:704-12 (2001)) describes a chimeric helper comprising both adenovirus and the AAV rep and cap genes.

Herpesvirus may also be used as a helper virus in AAV packaging methods. Hybrid herpesviruses encoding the AAV Rep protein(s) may advantageously facilitate scalable AAV vector production schemes. A hybrid herpes simplex virus type I (HSV-1) vector expressing the AAV2 rep and cap genes has been described, e.g., PCT Publication No. WO 00/17377, incorporated by reference herein.

As a further alternative, the virus vectors of the invention can be produced in insect cells using baculovirus vectors to deliver the rep/cap genes and rAAV template.

AAV vector stocks free of contaminating helper virus may be obtained by any method known in the art. For example, AAV and helper virus may be readily differentiated based on size. AAV may also be separated away from helper virus based on affinity for a heparin substrate. Deleted replication-defective helper viruses can be used so that any contaminating helper virus is not replication competent. As a further alternative, an adenovirus helper lacking late gene expression may be employed, as only adenovirus early gene expression is required to mediate packaging of AAV virus. Adenovirus mutants defective for late gene expression are known in the art (e.g., ts100K and ts149 adenovirus mutants).

Recombinant Virus Vectors

The virus vectors of the present invention are useful for the delivery of nucleic acids to cells in vitro, ex vivo, and in vivo. In particular, the virus vectors (comprising modified capsid protein AAV2.5, e.g., wherein the modified AAV2.5 capsid protein does not contain a substitution at the position corresponding to amino acid 267 of AAV2.5, and/or does not contain a seine substitution at the position corresponding to amino acid 267 of AAV2.5) can be advantageously employed to deliver or transfer nucleic acids to animal cells, including e.g., mammalian cells.

Any heterologous nucleic acid sequence(s) of interest may be delivered in the virus vectors of the present invention. Nucleic acids of interest include nucleic acids encoding polypeptides, including therapeutic (e.g., for medical or veterinary uses) and/or immunogenic (e.g., for vaccines) polypeptides.

Therapeutic polypeptides include, but are not limited to, cystic fibrosis transmembrane regulator protein (CFTR), dystrophin (including mini- and micro-dystrophins, see, e.g., Vincent et al. *Nature Genetics* 5:130 (1993); U.S. Patent Publication No. 2003017131; PCT Publication No. WO/2008/088895, Wang et al. *Proc. Natl. Acad. Sci. USA* 97:13714-13719 (2000); and Gregorevic et al. *Mol. Ther.* 16:657-64 (2008)), myostatin propeptide, follistatin, activin type II soluble receptor, IGF-1, anti-inflammatory polypeptides such as the I kappa B dominant mutant, sarcospan, utrophin (Tinsley et al. *Nature* 384:349 (1996)), mini-utrophin, clotting factors (e.g., Factor VIII, Factor IX, Factor X, etc.), erythropoietin, angiostatin, endostatin, catalase, tyrosine hydroxylase, superoxide dismutase, leptin, the LDL receptor, lipoprotein lipase, ornithine transcarbamylase, β-globin, α-globin, spectrin, $α_1$-antitrypsin, adenosine deaminase, hypoxanthine guanine phosphoribosyl transferase, β-glucocerebrosidase, sphingomyelinase, lysosomal hexosaminidase A, branched-chain keto acid dehydrogenase, RP65 protein, cytokines (e.g., α-interferon, β-interferon, interferon-γ, interleukin-2, interleukin-4, granulocyte-macrophage colony stimulating factor, lymphotoxin, and the like), peptide growth factors, neurotrophic factors and hormones (e.g., somatotropin, insulin, insulin-like growth factors 1 and 2, platelet derived growth factor, epidermal growth factor, fibroblast growth factor, nerve growth factor, neurotrophic factor-3 and -4, brain-derived neurotrophic factor, bone morphogenic proteins [including RANKL and VEGF], glial derived growth factor, transforming growth factor-α and -β, and the like), lysosomal acid α-glucosidase, α-galactosidase A, receptors (e.g., the tumor necrosis growth factor α soluble receptor), S100A1, parvalbumin, adenylyl cyclase type 6, a molecule that modulates calcium handling (e.g., $SERCA_{2A}$, Inhibitor 1 of PP1 and fragments thereof [e.g., PCT Publication Nos. WO 2006/029319 and WO 2007/100465]), a molecule that effects G-protein coupled receptor kinase type 2 knockdown such as a truncated constitutively active bARKct, anti-inflammatory factors such as IRAP, anti-myostatin proteins, aspartoacylase, monoclonal antibodies (including single chain monoclonal antibodies; an exemplary Mab being the Herceptin® Mab), neuropeptides and fragments thereof (e.g., galanin, Neuropeptide Y (see U.S. Pat. No. 7,071,172), angiogenesis inhibitors such as Vasohibins and other VEGF inhibitors (e.g., Vasohibin 2 [see PCT Publication WO JP2006/073052]). Other illustrative heterologous nucleic acid sequences encode suicide gene products (e.g., thymidine kinase, cytosine deaminase, diphtheria toxin, and tumor necrosis factor), proteins conferring resistance to a drug used in cancer therapy, tumor suppressor gene products (e.g., p53, Rb, Wt-1), TRAIL, FAS-ligand, and any other polypeptide that has a therapeutic effect in a subject in need thereof. AAV vectors can also be used to deliver monoclonal antibodies and antibody fragments, for example, an antibody or antibody fragment directed against myostatin (see, e.g., Fang et al. *Nature Biotechnology* 23:584-590 (2005)).

Heterologous nucleic acid sequences encoding polypeptides include those encoding reporter polypeptides (e.g., an enzyme). Reporter polypeptides are known in the art and include, but are not limited to, green fluorescent protein (GFP), β-galactosidase, alkaline phosphatase, luciferase, and chloramphenicol acetyltransferase gene.

Optionally, the heterologous nucleic acid encodes a secreted polypeptide (e.g., a polypeptide that is a secreted polypeptide in its native state or that has been engineered to be secreted, for example, by operable association with a secretory signal sequence as is known in the art).

Alternatively, in particular embodiments of this invention, the heterologous nucleic acid may encode an antisense nucleic acid, a ribozyme (e.g., as described in U.S. Pat. No. 5,877,022), RNAs that effect spliceosome-mediated trans-splicing (see, Puttaraju et al. *Nature Biotech.* 17:246 (1999); U.S. Pat. Nos. 6,013,487; 6,083,702), interfering RNAs (RNAi) including siRNA, shRNA or miRNA that mediate gene silencing (see, Sharp et al. *Science* 287:2431 (2000)), and other non-translated RNAs, such as "guide" RNAs (Gorman et al. *Proc. Nat. Acad. Sci. USA* 95:4929 (1998); U.S. Pat. No. 5,869,248 to Yuan et al.), and the like. Exemplary untranslated RNAs include RNAi against a multiple drug resistance (MDR) gene product (e.g., to treat and/or prevent tumors and/or for administration to the heart to prevent damage by chemotherapy), RNAi against myostatin (e.g., for Duchenne muscular dystrophy), RNAi against VEGF (e.g., to treat and/or prevent tumors), RNAi against phospholamban (e.g., to treat cardiovascular disease, see e.g., Andino et al. *J. Gene Med.* 10:132-142 (2008) and Li et al. *Acta Pharmacol Sin.* 26:51-55 (2005)); phospholamban inhibitory or dominant-negative molecules such as phospholamban S16E (e.g., to treat cardiovascular disease, see e.g., Hoshijima et al. *Nat. Med.* 8:864-871 (2002)), RNAi to adenosine kinase (e.g., for epilepsy), and RNAi directed against pathogenic organisms and viruses (e.g., hepatitis B and/or C virus, human immunodeficiency virus, CMV, herpes simplex virus, human papilloma virus, etc.).

Further, a nucleic acid sequence that directs alternative splicing can be delivered. To illustrate, an antisense sequence (or other inhibitory sequence) complementary to the 5' and/or 3' splice site of dystrophin exon 51 can be delivered in conjunction with a U1 or U7 small nuclear (sn) RNA promoter to induce skipping of this exon. For example, a DNA sequence comprising a U1 or U7 snRNA promoter located 5' to the antisense/inhibitory sequence(s) can be packaged and delivered in a modified capsid of the invention.

The virus vector may also comprise a heterologous nucleic acid that shares homology with and recombines with a locus on a host chromosome. This approach can be utilized, for example, to correct a genetic defect in the host cell.

The present invention also provides virus vectors that express an immunogenic polypeptide, e.g., for vaccination. The nucleic acid may encode any immunogen of interest known in the art including, but not limited to, immunogens from human immunodeficiency virus (HIV), simian immunodeficiency virus (SIV), influenza virus, HIV or SIV gag proteins, tumor antigens, cancer antigens, bacterial antigens, viral antigens, and the like.

The use of parvoviruses as vaccine vectors is known in the art (see, e.g., Miyamura et al. *Proc. Nat. Acad. Sci USA* 91:8507 (1994); U.S. Pat. No. 5,916,563 to Young et al., U.S. Pat. No. 5,905,040 to Mazzara et al., U.S. Pat. Nos.

5,882,652, 5,863,541 to Samulski et al.). The antigen may be presented in the parvovirus capsid. Alternatively, the antigen may be expressed from a heterologous nucleic acid introduced into a recombinant vector genome. Any immunogen of interest as described herein and/or as is known in the art can be provided by the virus vector of the present invention.

An immunogenic polypeptide can be any polypeptide suitable for eliciting an immune response and/or protecting the subject against an infection and/or disease, including, but not limited to, microbial, bacterial, protozoal, parasitic, fungal and/or viral infections and diseases. For example, the immunogenic polypeptide can be an orthomyxovirus immunogen (e.g., an influenza virus immunogen, such as the influenza virus hemagglutinin (HA) surface protein or the influenza virus nucleoprotein, or an equine influenza virus immunogen) or a lentivirus immunogen (e.g., an equine infectious anemia virus immunogen, a Simian Immunodeficiency Virus (SIV) immunogen, or a Human Immunodeficiency Virus (HIV) immunogen, such as the HIV or SIV envelope GP160 protein, the HIV or SIV matrix/capsid proteins, and the HIV or SIV gag, pol and env gene products). The immunogenic polypeptide can also be an arenavirus immunogen (e.g., Lassa fever virus immunogen, such as the Lassa fever virus nucleocapsid protein and/or the Lassa fever envelope glycoprotein), a poxvirus immunogen (e.g., a vaccinia virus immunogen, such as the vaccinia L1 or L8 gene product), a flavivirus immunogen (e.g., a yellow fever virus immunogen or a Japanese encephalitis virus immunogen), a filovirus immunogen (e.g., an Ebola virus immunogen, or a Marburg virus immunogen, such as NP and GP gene products), a bunyavirus immunogen (e.g., RVFV, CCHF, and/or SFS virus immunogens), or a coronavirus immunogen (e.g., an infectious human coronavirus immunogen, such as the human coronavirus envelope glycoprotein, or a porcine transmissible gastroenteritis virus immunogen, or an avian infectious bronchitis virus immunogen). The immunogenic polypeptide can further be a polio immunogen, a herpesvirus immunogen (e.g., CMV, EBV, HSV immunogens) a mumps virus immunogen, a measles virus immunogen, a rubella virus immunogen, a diphtheria toxin or other diphtheria immunogen, a pertussis antigen, a hepatitis (e.g., hepatitis A, hepatitis B, hepatitis C, etc.) immunogen, and/or any other vaccine immunogen now known in the art or later identified as an immunogen.

Alternatively, the immunogenic polypeptide can be any tumor or cancer cell antigen. Optionally, the tumor or cancer antigen is expressed on the surface of the cancer cell. Exemplary cancer and tumor cell antigens are described in S. A. Rosenberg (*Immunity* 10:281 (1991)). Other illustrative cancer and tumor antigens include, but are not limited to: BRCA1 gene product, BRCA2 gene product, gp100, tyrosinase, GAGE-1/2, BAGE, RAGE, LAGE, NY-ESO-1, CDK-4, β-catenin, MUM-1, Caspase-8, KIAA0205, HPVE, SART-1, PRAME, p15, melanoma tumor antigens (Kawakami et al. *Proc. Natl. Acad. Sci. USA* 91:3515 (1994); Kawakami et al. *J. Exp. Med.*, 180:347 (1994); Kawakami et al. *Cancer Res.* 54:3124 (1994)), MART-1, gp100 MAGE-1, MAGE-2, MAGE-3, CEA, TRP-1, TRP-2, P-15, tyrosinase (Brichard et al. *J. Exp. Med.* 178:489 (1993)); HER-2/neu gene product (U.S. Pat. No. 4,968,603), CA125, LK26, FB5 (endosialin), TAG 72, AFP, CA19-9, NSE, DU-PAN-2, CA50, SPan-1, CA72-4, HCG, STN (sialyl Tn antigen), c-erbB-2 proteins, PSA, L-CanAg, estrogen receptor, milk fat globulin, p53 tumor suppressor protein (Levine. *Ann. Rev. Biochem.* 62:623 (1993)); mucin antigens (PCT Publication No. WO 90/05142); telomerases; nuclear matrix proteins; prostatic acid phosphatase; papilloma virus antigens; and/or antigens now known or later discovered to be associated with the following cancers: melanoma, adenocarcinoma, thymoma, lymphoma (e.g., non-Hodgkin's lymphoma, Hodgkin's lymphoma), sarcoma, lung cancer, liver cancer, colon cancer, leukemia, uterine cancer, breast cancer, prostate cancer, ovarian cancer, cervical cancer, bladder cancer, kidney cancer, pancreatic cancer, brain cancer and any other cancer or malignant condition now known or later identified (see, e.g., Rosenberg. *Ann. Rev. Med.* 47:481-91 (1996)).

As a further alternative, the heterologous nucleic acid can encode any polypeptide that is desirably produced in a cell in vitro, ex vivo, or in vivo. For example, the virus vectors may be introduced into cultured cells and the expressed nucleic acid product isolated therefrom.

It will be understood by those skilled in the art that the heterologous nucleic acid(s) of interest can be operably associated with appropriate control sequences. For example, the heterologous nucleic acid can be operably associated with expression control elements, such as transcription/translation control signals, origins of replication, polyadenylation signals, internal ribosome entry sites (IRES), promoters, and/or enhancers, and the like.

Further, regulated expression of the heterologous nucleic acid(s) of interest can be achieved at the post-transcriptional level, e.g., by regulating selective splicing of different introns by the presence or absence of an oligonucleotide, small molecule and/or other compound that selectively blocks splicing activity at specific sites (e.g., as described in PCT Publication No. WO 2006/119137).

Those skilled in the art will appreciate that a variety of promoter/enhancer elements can be used depending on the level and tissue-specific expression desired. The promoter/enhancer can be constitutive or inducible, depending on the pattern of expression desired. The promoter/enhancer can be native or foreign and can be a natural or a synthetic sequence. By foreign, it is intended that the transcriptional initiation region is not found in the wild-type host into which the transcriptional initiation region is introduced.

In particular embodiments, the promoter/enhancer elements can be native to the target cell or subject to be treated. In representative embodiments, the promoters/enhancer element can be native to the heterologous nucleic acid sequence. The promoter/enhancer element is generally chosen so that it functions in the target cell(s) of interest. Further, in particular embodiments the promoter/enhancer element is a mammalian promoter/enhancer element. The promoter/enhancer element may be constitutive or inducible.

Inducible expression control elements are typically advantageous in those applications in which it is desirable to provide regulation over expression of the heterologous nucleic acid sequence(s). Inducible promoters/enhancer elements for gene delivery can be tissue-specific or preferred promoter/enhancer elements, and include muscle specific or preferred (including cardiac, skeletal and/or smooth muscle specific or preferred), neural tissue specific or preferred (including brain-specific or preferred), eye specific or preferred (including retina-specific and cornea-specific), liver specific or preferred, bone marrow specific or preferred, pancreatic specific or preferred, spleen specific or preferred, and/or lung specific or preferred promoter/enhancer elements. Other inducible promoter/enhancer elements include hormone-inducible and metal-inducible elements. Exemplary inducible promoters/enhancer elements include, but are not limited to, a Tet on/off element, a RU486-inducible promoter, an ecdysone-inducible promoter, a rapamycin-inducible promoter, and a metallothionein promoter.

In embodiments wherein the heterologous nucleic acid sequence(s) is transcribed and then translated in the target cells, specific initiation signals are generally included for efficient translation of inserted protein coding sequences. These exogenous translational control sequences, which may include the ATG initiation codon and adjacent sequences, can be of a variety of origins, both natural and synthetic.

The virus vectors according to the present invention provide a means for delivering heterologous nucleic acids into a broad range of cells, including dividing and non-dividing cells. The virus vectors can be employed, for example, to deliver a nucleic acid of interest to a cell in vitro, e.g., to produce a polypeptide in vitro or for ex vivo gene therapy. The virus vectors are additionally useful in a method of delivering a nucleic acid to a subject in need thereof, e.g., to express an immunogenic and/or therapeutic polypeptide and/or a functional RNA. In this manner, the polypeptide and/or functional RNA can be produced in vivo in the subject. The subject can be in need of the polypeptide because the subject has a deficiency of the polypeptide. Further, the method can be practiced because the production of the polypeptide and/or functional RNA in the subject may impart some beneficial effect.

The virus vectors can also be used to produce a polypeptide of interest and/or functional RNA in cultured cells or in a subject (e.g., using the subject as a bioreactor to produce the polypeptide and/or to observe the effects of the functional RNA on the subject, for example, in connection with screening methods).

In general, the virus vectors of the present invention can be employed to deliver a heterologous nucleic acid encoding a polypeptide and/or functional RNA (e.g., a therapeutic polypeptide, e.g., a therapeutic nucleic acid) to treat and/or prevent any disease state or disorder for which it is beneficial to deliver a therapeutic polypeptide and/or functional RNA, e.g., to a subject in need thereof, e.g., wherein the subject has or is at risk for a disease state or disorder. In some embodiments, the disease state is a CNS disease or disorder. In some embodiments, the subject has or is at risk of having pain associated with a disease or disorder. In some embodiments, the subject is a human. In some embodiments, the subject is in utero.

Illustrative disease states include, but are not limited to: cystic fibrosis (cystic fibrosis transmembrane regulator protein) and other diseases of the lung, hemophilia A (Factor VIII), hemophilia B (Factor IX), thalassemia (ß-globin), anemia (erythropoietin) and other blood disorders, Alzheimer's disease (GDF; neprilysin), multiple sclerosis (ß-interferon), Parkinson's disease (glial-cell line derived neurotrophic factor [GDNF]), Huntington's disease (RNAi to remove repeats), amyotrophic lateral sclerosis, epilepsy (galanin, neurotrophic factors), and other neurological disorders, cancer (endostatin, angiostatin, TRAIL, FAS-ligand, cytokines including interferons; RNAi including RNAi against VEGF or the multiple drug resistance gene product, mir-26a [e.g., for hepatocellular carcinoma]), diabetes mellitus (insulin), muscular dystrophies including Duchenne (dystrophin, mini-dystrophin, insulin-like growth factor I, a sarcoglycan [e.g., α, β, γ], RNAi against myostatin, myostatin propeptide, follistatin, activin type II soluble receptor, anti-inflammatory polypeptides such as the Ikappa B dominant mutant, sarcospan, utrophin, mini-utrophin, antisense or RNAi against splice junctions in the dystrophin gene to induce exon skipping [see e.g., PCT Publication No. WO/2003/095647], antisense against U7 snRNAs to induce exon skipping [see e.g., PCT Publication No. WO/2006/021724], and antibodies or antibody fragments against myostatin or myostatin propeptide) and Becker, Gaucher disease (glucocerebrosidase), Hurler's disease (α-L-iduronidase), adenosine deaminase deficiency (adenosine deaminase), glycogen storage diseases (e.g., Fabry disease [α-galactosidase] and Pompe disease [lysosomal acid α-glucosidase]) and other metabolic disorders, congenital emphysema (α1-antitrypsin), Lesch-Nyhan Syndrome (hypoxanthine guanine phosphoribosyl transferase), Niemann-Pick disease (sphingomyelinase), Tay Sachs disease (lysosomal hexosaminidase A), Maple Syrup Urine Disease (branched-chain keto acid dehydrogenase), retinal degenerative diseases (and other diseases of the eye and retina; e.g., PDGF for macular degeneration and/or vasohibin or other inhibitors of VEGF or other angiogenesis inhibitors to treat/prevent retinal disorders, e.g., in Type I diabetes), diseases of solid organs such as brain (including Parkinson's Disease [GDNF], astrocytomas [endostatin, angiostatin and/or RNAi against VEGF], glioblastomas [endostatin, angiostatin and/or RNAi against VEGF]), liver, kidney, heart including congestive heart failure or peripheral artery disease (PAD) (e.g., by delivering protein phosphatase inhibitor I (I-1) and fragments thereof (e.g., I1C), serca2a, zinc finger proteins that regulate the phospholamban gene, Barkct, β2-adrenergic receptor, β2-adrenergic receptor kinase (BARK), phosphoinositide-3 kinase (PI3 kinase), S100A1, parvalbumin, adenylyl cyclase type 6, a molecule that effects G-protein coupled receptor kinase type 2 knockdown such as a truncated constitutively active bARKct; calsarcin, RNAi against phospholamban; phospholamban inhibitory or dominant-negative molecules such as phospholamban S16E, etc.), arthritis (insulin-like growth factors), joint disorders (insulin-like growth factor 1 and/or 2), intimal hyperplasia (e.g., by delivering enos, inos), improve survival of heart transplants (superoxide dismutase), AIDS (soluble CD4), muscle wasting (insulin-like growth factor I), kidney deficiency (erythropoietin), anemia (erythropoietin), arthritis (anti-inflammatory factors such as IRAP and TNFα soluble receptor), hepatitis (α-interferon), LDL receptor deficiency (LDL receptor), hyperammonemia (ornithine transcarbamylase), Krabbe's disease (galactocerebrosidase), Batten's disease, spinal cerebral ataxias including SCA1, SCA2 and SCA3, phenylketonuria (phenylalanine hydroxylase), autoimmune diseases, congenital neurodegenerative disorders (e.g., monogenic neurodegenerative disorders) such as mucopolysaccharidosis (including, but not limited to, Mucopolysaccharidosis Type I (also known as Hurler syndrome, Hurler-Scheie Syndrome, or Scheie syndrome, IDUA, alpha-L-iduronidase), Mucopolysaccharidosis Type II (also known as Hunter syndrome, IDS, I2L enzyme), Mucopolysaccharidosis Type III (also known as Sanfilippo syndrome, GNS [N-acetylglucosamine-6-sulfatase], HGSNAT [heparan-alpha-glucosaminide N-acetyltransferase], NAGLU [alpha-N-acetylglucosaminidase], and/or SGSH [sulfamidase]), Mucopolysaccharidosis Type IV (also known as Morquio syndrome, GALNS [galatosamine (N-acetyl)-6-sulfatase] and/or GLB1 [beta-galactosidase]), Mucopolysaccharidosis Type V (also known as Scheie syndrome, now a subgroup of type I, also IDUA, alpha-L-iduronidase), Mucopolysaccharidosis Type VI (also known as Maroteaux-Lamy syndrome, ARSB, arylsulfatase B), Mucopolysaccharidosis Type VII (also known as Sly syndrome, GUSB, beta-glucuronidase), Mucopolysaccharidosis Type IX (also known as Natowicz syndrome, HYAL1, hyaluronidase) and/or leukodystrophy (including, but not limited to, adult-onset autosomal dominant leukodystrophy (ADLD; LMNB1, lamin B1), Aicardi-Goutieres syndrome (TREX1, RNASEHSB, RNASEH2C, and/or RNASEH2A), Alexander disease (FRAP, glial fibrillary acidic protein), CADASIL (Notch3), Canavan disease (ASPA, aspartoacylase), CARASIL (HTRA1, serine protease HTRA1), cerebrotendinous xanthomatosis ("CTX," CYP27A1, sterol 27-hydroxylase) childhood ataxia and cerebral hypomyelination (CACH)/vanishing white matter disease (VWMD) (eIF2B, eukaryotic initiation factor 2B), Fabry disease (GLA, alpha-galactosidase A), fucosidosis (FUCA1, alpha-L-fucosidase), GM1 gangliosidosis (GLB1, beta-galactosidase), L-2-hydroxyglutaric aciduria (L2HDGH, L-2-hydroxyglutarate dehydrogenase), Krabbe disease (GALC, galactocerebrosidase), megalencephalic leukoencephalopathy with subcortical cysts ("MLC," MLC1 and/or HEPACAM), metachromatic leukodystrophy (ASA, arylsulphatase A), multiple sulfatase deficiency ("MSD," SUMF1, sulfatase modifying factor 1 affecting all sulfatase enzymes), Pelizaeus-Merzbacher disease (also known as "X-linked spastic paraplegia," PLP1 [X-linked proteolipid protein 1] and/or GJA12 [gap junction protein 12]), Pol III-Related Leukodystrophies (POLR3A and/or POLR3B), Refsum disease (PHYH, [phytanoyl-CoA hydroxylase] and/or Pex7 [PHYH importer into peroxisomes]), salla disease (also known as "free sialic acid storage disease," SLC17A5, sialic acid transporter), Sjogren-Larsson syndrome (ALDH3A2, aldehyde dehydrogenase), X-linked adrenoleukodystrophy ("ALD," ABCD1, peroxisomal ATPase Binding Cassette protein), Zellweger syndrome spectrum disorders (also known as peroxisomal biogenesis disorders, PEX1, PEX2, PEX3, PEX4, PEX5, PEX10, PEX11B, PEX12, PEX13, PEX14, PEX16, PEX19, PEX26), and the like. The invention can further be used following organ transplantation to increase the success of the transplant and/or to reduce the negative side effects of organ transplantation or adjunct therapies (e.g., by administering immunosuppressant agents or inhibitory nucleic acids to block cytokine production). As another example, bone morphogenic proteins (including BNP 2, 7, etc., RANKL and/or VEGF) can be administered with a bone allograft, for example, following a break or surgical removal in a cancer patient.

Thus, in some embodiments, the present invention provides a method of treating a disease in a subject in need thereof, comprising introducing a therapeutic nucleic acid into a cell of the subject by administering to the subject the virus vector and/or composition of the present invention, under conditions whereby the therapeutic nucleic acid is expressed in the subject.

The invention can also be used to produce induced pluripotent stem cells (iPS). For example, a virus vector of the invention can be used to deliver stem cell associated nucleic acid(s) into a non-pluripotent cell, such as adult fibroblasts, skin cells, liver cells, renal cells, adipose cells, cardiac cells, neural cells, epithelial cells, endothelial cells, and the like. Nucleic acids encoding factors associated with stem cells are known in the art. Nonlimiting examples of such factors associated with stem cells and pluripotency include Oct-3/4, the SOX family (e.g., SOX1, SOX2, SOX3 and/or SOX15), the Klf family (e.g., Klf1, Klf2, Klf4 and/or Klf5), the Myc family (e.g., C-myc, L-myc and/or N-myc), NANOG and/or LIN28.

The invention can also be practiced to treat and/or prevent a metabolic disorder such as diabetes (e.g., insulin), hemophilia (e.g., Factor IX or Factor VIII), a lysosomal storage disorder such as a mucopolysaccharidosis disorder (e.g., Sly syndrome [β-glucuronidase], Hurler Syndrome [α-L-iduronidase], Scheie Syndrome [α-L-iduronidase], Hurler-Scheie Syndrome [α-L-iduronidase], Hunter's Syndrome [iduronate sulfatase], Sanfilippo Syndrome A [heparan sulfamidase], B [N-acetylglucosaminidase], C [acetyl-CoA:α-glucosaminide acetyltransferase], D [N-acetylglucosamine 6-sulfatase], Morquio Syndrome A [galactose-6-sulfate sulfatase], B [β-galactosidase], Maroteaux-Lamy Syndrome [N-acetylgalactosamine-4-sulfatase], etc.), Fabry disease (α-galactosidase), Gaucher's disease (glucocerebrosidase), or a glycogen storage disorder (e.g., Pompe disease; lysosomal acid α-glucosidase).

Gene transfer has substantial potential use for understanding and providing therapy for disease states. There are a number of inherited diseases in which defective genes are known and have been cloned. In general, the above disease states fall into two classes: deficiency states, usually of enzymes, which are generally inherited in a recessive manner, and unbalanced states, which may involve regulatory or structural proteins, and which are typically inherited in a dominant manner. For deficiency state diseases, gene transfer can be used to bring a normal gene into affected tissues for replacement therapy, as well as to create animal models for the disease using antisense mutations. For unbalanced disease states, gene transfer can be used to create a disease state in a model system, which can then be used in efforts to counteract the disease state. Thus, virus vectors according to the present invention permit the treatment and/or prevention of genetic diseases.

The virus vectors comprising a modified AAV2.5 capsid protein (e.g., wherein the modified AAV2.5 capsid protein does not contain a substitution at the position corresponding to amino acid 267 of AAV2.5, and/or does not contain a serine substitution at the position corresponding to amino acid 267 of AAV2.5) according to the present invention may also be employed to provide a functional RNA to a cell in vitro or in vivo. Expression of the functional RNA in the cell, for example, can diminish expression of a particular target protein by the cell. Accordingly, functional RNA can be administered to decrease expression of a particular protein in a subject in need thereof. Functional RNA can also be administered to cells in vitro to regulate gene expression and/or cell physiology, e.g., to optimize cell or tissue culture systems or in screening methods.

In addition, virus vectors comprising a modified AAV2.5 capsid protein (e.g., wherein the modified AAV2.5 capsid protein does not contain a substitution at the position corresponding to amino acid 267 of AAV2.5, and/or does not contain a serine substitution at the position corresponding to amino acid 267 of AAV2.5) according to the instant invention find use in diagnostic and screening methods, whereby a nucleic acid of interest is transiently or stably expressed in a cell culture system, or alternatively, a transgenic animal model.

The virus vectors of the present invention can also be used for various non-therapeutic purposes, including but not limited to use in protocols to assess gene targeting, clearance, transcription, translation, etc., as would be apparent to one skilled in the art. The virus vectors can also be used for the purpose of evaluating safety (spread, toxicity, immunogenicity, etc.). Such data, for example, are considered by the United States Food and Drug Administration as part of the regulatory approval process prior to evaluation of clinical efficacy.

As a further aspect, the virus vectors of the present invention may be used to produce an immune response in a subject. According to this embodiment, a virus vector comprising a heterologous nucleic acid sequence encoding an immunogenic polypeptide can be administered to a subject, and an active immune response is mounted by the subject against the immunogenic polypeptide. Immunogenic polypeptides are as described hereinabove. In some embodiments, a protective immune response is elicited.

Alternatively, the virus vector may be administered to a cell ex vivo and the altered cell is administered to the subject. The virus vector comprising the heterologous nucleic acid is introduced into the cell, and the cell is administered to the subject, where the heterologous nucleic acid encoding the immunogen can be expressed and induce an immune response in the subject against the immunogen. In particular embodiments, the cell is an antigen-presenting cell (e.g., a dendritic cell).

An "active immune response" or "active immunity" is characterized by "participation of host tissues and cells after an encounter with the immunogen. It involves differentiation and proliferation of immunocompetent cells in lymphoreticular tissues, which lead to synthesis of antibody or the development of cell-mediated reactivity, or both." Herbert B. Herscowitz. *Immunophysiology: Cell Function and Cellular Interactions in Antibody Formation*, in IMMUNOLOGY: BASIC PROCESSES 117 (Joseph A. Bellanti ed., 1985). Alternatively stated, an active immune response is mounted by the host after exposure to an immunogen by infection or by vaccination. Active immunity can be contrasted with passive immunity, which is acquired through the "transfer of preformed substances (antibody, transfer factor, thymic graft, interleukin-2) from an actively immunized host to a non-immune host." Id.

A "protective" immune response or "protective" immunity as used herein indicates that the immune response confers some benefit to the subject in that it prevents or reduces the incidence of disease. Alternatively, a protective immune response or protective immunity may be useful in the treatment and/or prevention of disease, in particular cancer or tumors (e.g., by preventing cancer or tumor formation, by causing regression of a cancer or tumor and/or by preventing metastasis and/or by preventing growth of metastatic nodules). The protective effects may be complete or partial, as long as the benefits of the treatment outweigh any disadvantages thereof.

In particular embodiments, the virus vector or cell comprising the heterologous nucleic acid can be administered in an immunogenically effective amount, as described herein.

The virus vectors of the present invention can also be administered for cancer immunotherapy by administration of a virus vector expressing one or more cancer cell antigens (or an immunologically similar molecule) or any other immunogen that produces an immune response against a cancer cell. To illustrate, an immune response can be produced against a cancer cell antigen in a subject by administering a virus vector comprising a heterologous nucleic acid encoding the cancer cell antigen, for example to treat a patient with cancer and/or to prevent cancer from developing in the subject. The virus vector may be administered to a subject in vivo or by using ex vivo methods, as described herein. Alternatively, the cancer antigen can be expressed as part of the virus capsid or be otherwise associated with the virus capsid (e.g., as described above).

As another alternative, any other therapeutic nucleic acid (e.g., RNAi) or polypeptide (e.g., cytokine) known in the art can be administered to treat and/or prevent cancer.

As used herein, the term "cancer" encompasses tumor-forming cancers. Likewise, the term "cancerous tissue" encompasses tumors. A "cancer cell antigen" encompasses tumor antigens.

The term "cancer" has its understood meaning in the art, for example, an uncontrolled growth of tissue that has the potential to spread to distant sites of the body (i.e., metastasize). Exemplary cancers include, but are not limited to melanoma, adenocarcinoma, thymoma, lymphoma (e.g., non-Hodgkin's lymphoma, Hodgkin's lymphoma), sarcoma, lung cancer, liver cancer, colon cancer, leukemia, uterine cancer, breast cancer, prostate cancer, ovarian cancer, cervical cancer, bladder cancer, kidney cancer, pancreatic cancer, brain cancer and any other cancer or malignant condition now known or later identified. In representative embodiments, the invention provides a method of treating and/or preventing tumor-forming cancers.

The term "tumor" is also understood in the art, for example, as an abnormal mass of undifferentiated cells within a multicellular organism. Tumors can be malignant or benign. In representative embodiments, the methods disclosed herein are used to prevent and treat malignant tumors.

By the terms "treating cancer," "treatment of cancer" and equivalent terms it is intended that the severity of the cancer is reduced or at least partially eliminated and/or the progression of the disease is slowed and/or controlled and/or the disease is stabilized. In particular embodiments, these terms indicate that metastasis of the cancer is prevented or reduced or at least partially eliminated and/or that growth of metastatic nodules is prevented or reduced or at least partially eliminated.

By the terms "prevention of cancer" or "preventing cancer" and equivalent terms it is intended that the methods at least partially eliminate or reduce and/or delay the incidence and/or severity of the onset of cancer. Alternatively stated, the onset of cancer in the subject may be reduced in likelihood or probability and/or delayed.

In particular embodiments, cells may be removed from a subject with cancer and contacted with a virus vector expressing a cancer cell antigen according to the instant invention. The modified cell is then administered to the subject, whereby an immune response against the cancer cell antigen is elicited. This method can be advantageously employed with immunocompromised subjects that cannot mount a sufficient immune response in vivo (i.e., cannot produce enhancing antibodies in sufficient quantities).

It is known in the art that immune responses may be enhanced by immunomodulatory cytokines (e.g., α-interferon, β-interferon, γ-interferon, ω-interferon, τ-interferon, interleukin-1α, interleukin-1β, interleukin-2, interleukin-3, interleukin-4, interleukin 5, interleukin-6, interleukin-7, interleukin-8, interleukin-9, interleukin-10, interleukin-11, interleukin 12, interleukin-13, interleukin-14, interleukin-18, B cell Growth factor, CD40 Ligand, tumor necrosis factor-α, tumor necrosis factor-β, monocyte chemoattractant protein-1, granulocyte-macrophage colony stimulating factor, and lymphotoxin). Accordingly, immunomodulatory cytokines (preferably, CTL inductive cytokines) may be administered to a subject in conjunction with the virus vector.

Cytokines may be administered by any method known in the art. Exogenous cytokines may be administered to the subject, or alternatively, a nucleic acid encoding a cytokine may be delivered to the subject using a suitable vector, and the cytokine produced in vivo.

Subjects, Pharmaceutical Formulations, and Modes of Administration

Virus vectors and capsids comprising a modified AAV2.5 capsid protein (comprising a modified AAV2.5 capsid protein (e.g., wherein the modified AAV2.5 capsid protein does not contain a substitution at the position corresponding to amino acid 267 of AAV2.5, and/or does not contain a serine substitution at the position corresponding to amino acid 267 of AAV2.5)) according to the present invention find use in both veterinary and medical applications. Suitable subjects include both avians and mammals. The term "avian" as used herein includes, but is not limited to, chickens, ducks, geese, quail, turkeys, pheasant, parrots, parakeets, and the like. The term "mammal" as used herein includes, but is not limited to, humans, non-human primates, bovines, ovines, caprines, equines, felines, canines, lagomorphs, etc. A subject can be a fully developed subject (e.g., an adult) or a subject undergoing the developmental process (e.g., a child, infant or fetus). Human subjects include in utero (e.g., embryos, fetuses), neonates, infants, juveniles, adults and geriatric subjects.

In representative embodiments, the subject is "in need of" the methods of the invention and thus in some embodiments can be a "subject in need thereof."

In particular embodiments, the present invention provides a pharmaceutical composition comprising a virus vector and/or capsid comprising a modified AAV2.5 capsid protein (comprising a modified AAV2.5 capsid protein (e.g., wherein the modified AAV2.5 capsid protein does not contain a substitution at the position corresponding to amino acid 267 of AAV2.5, and/or does not contain a serine substitution at the position corresponding to amino acid 267 of AAV2.5)) of the invention in a pharmaceutically acceptable carrier and, optionally, other medicinal agents, pharmaceutical agents, stabilizing agents, buffers, carriers, adjuvants, diluents, etc. For injection, the carrier will typically be a liquid. For other methods of administration, the carrier may be either solid or liquid. For inhalation administration, the carrier will be respirable, and optionally can be in solid or liquid particulate form.

By "pharmaceutically acceptable" it is meant a material that is not toxic or otherwise undesirable, i.e., the material may be administered to a subject without causing any undesirable biological effects.

One aspect of the present invention is a method of transferring a nucleic acid to a cell in vitro. The virus vector may be introduced into the cells at the appropriate multiplicity of infection according to standard transduction methods suitable for the particular target cells. Titers of virus vector to administer can vary, depending upon the target cell type and number, and the particular virus vector, and can be determined by those of skill in the art without undue experimentation. In representative embodiments, at least about 10 infectious units, optionally at least about $10^5$ infectious units are introduced to the cell.

The cell(s) into which the virus vector is introduced can be of any type, including but not limited to neural cells (including cells of the peripheral and central nervous systems, in particular, brain cells such as neurons and glial cells such as astrocytes and oligodendrocytes), lung cells, cells of the eye (including retinal cells, retinal pigment epithelium, and corneal cells), epithelial cells (e.g., gut and respiratory epithelial cells), muscle cells (e.g., skeletal muscle cells, cardiac muscle cells, smooth muscle cells and/or diaphragm muscle cells), dendritic cells, pancreatic cells (including islet cells), hepatic cells, myocardial cells, bone cells (e.g., bone marrow stem cells), hematopoietic stem cells, spleen cells, keratinocytes, fibroblasts, endothelial cells, prostate cells, germ cells, and the like. In representative embodiments, the cell can be any progenitor cell. As a further embodiment, the cell can be a stem cell (e.g., neural stem cell, liver stem cell).

As still a further embodiment, the cell can be a cancer or tumor cell. Moreover, the cell can be from any species of origin, as indicated above.

The virus vector can be introduced into cells in vitro for the purpose of administering the modified cell to a subject. In particular embodiments, the cells have been removed from a subject, the virus vector is introduced therein, and the cells are then administered back into the subject. Methods of removing cells from subject for manipulation ex vivo, followed by introduction back into the subject are known in the art (see, e.g., U.S. Pat. No. 5,399,346). Alternatively, the recombinant virus vector can be introduced into cells from a donor subject, into cultured cells, or into cells from any other suitable source, and the cells are administered to a subject in need thereof (i.e., a "recipient" subject).

Suitable cells for ex vivo nucleic acid delivery are as described above. Dosages of the cells to administer to a subject will vary upon the age, condition and species of the subject, the type of cell, the nucleic acid being expressed by the cell, the mode of administration, and the like. Typically, at least about $10^2$ to about $10^8$ cells or at least about $10^3$ to about $10^6$ cells will be administered per dose in a pharmaceutically acceptable carrier. In particular embodiments, the cells transduced with the virus vector are administered to the subject in a treatment effective or prevention effective amount in combination with a pharmaceutical carrier.

In some embodiments, the virus vector is introduced into a cell and the cell can be administered to a subject to elicit an immunogenic response against the delivered polypeptide (e.g., expressed as a transgene or in the capsid). Typically, a quantity of cells expressing an immunogenically effective amount of the polypeptide in combination with a pharmaceutically acceptable carrier is administered. An "immunogenically effective amount" is an amount of the expressed polypeptide that is sufficient to evoke an active immune response against the polypeptide in the subject to which the pharmaceutical formulation is administered. In particular embodiments, the dosage is sufficient to produce a protective immune response (as defined above). The degree of protection conferred need not be complete or permanent, as long as the benefits of administering the immunogenic polypeptide outweigh any disadvantages thereof.

In some embodiments, the subject may have a reduced immunologic profile (e.g., immunologic response, e.g., antigenic cross-reactivity) when contacted with a virus vector of the present invention as compared to a control, e.g., when contacted with another AAV virus vector (e.g., AAV1, AAV2, AAV9, AAV2.5, or any AAV serotype listed in Table 1).

A further aspect of the invention is a method of administering the virus vector and/or virus capsid to a subject. Administration of the virus vectors and/or capsids according to the present invention to a human subject or an animal in need thereof can be by any means known in the art. Optionally, the virus vector and/or capsid can be delivered in a treatment effective or prevention effective dose in a pharmaceutically acceptable carrier.

The virus vectors and/or capsids of the invention can further be administered to elicit an immunogenic response (e.g., as a vaccine). Typically, immunogenic compositions of the present invention comprise an immunogenically effective amount of virus vector and/or capsid in combination with a pharmaceutically acceptable carrier. Optionally, the dosage is sufficient to produce a protective immune response (as defined above).

Dosages of the virus vector and/or capsid to be administered to a subject depend upon the mode of administration, the disease or condition to be treated and/or prevented, the individual subject's condition, the particular virus vector or capsid, the nucleic acid to be delivered, and the like, and can be determined in a routine manner. Exemplary doses for achieving therapeutic effects are titers of at least about $10^5$, $10^6$, $10^7$, $10^8$, $10^9$, $10^{10}$, $10^{11}$, $10^{12}$, $10^1$, $10^{14}$, $10^{15}$ transducing units, optionally about $10^8$-$10^{13}$ transducing units.

In particular embodiments, more than one administration (e.g., two, three, four or more administrations) may be employed to achieve the desired level of gene expression over a period of various intervals, e.g., daily, weekly, monthly, yearly, etc.

"Repeated administration", "repeat dose" or "repeat dosing" or the like means at least one additional dose or dosing that is administered to a subject subsequent to an earlier dose or dosing of the same or similar material. For example, a repeated dose of a viral vector and/or therapeutic is at least one additional dose of the viral vector and/or therapeutic after a prior dose of the same material. While the material may be the same, the amount of the material in the repeated dose may be different from the earlier dose. For example, in an embodiment of any one of the methods or compositions provided herein, the amount of the viral vector and/or therapeutic in the repeated dose may be less than the amount of the viral vector and/or therapeutic of the earlier dose. Alternatively, in an embodiment of any one of the methods or compositions provided herein, the repeated dose may be in an amount that is at least equal to the amount of the viral vector and/or therapeutic in the earlier dose. A repeat dose may be administered weeks, months or years after the prior dose. In some embodiments of any one of the methods provided herein, the repeat dose or dosing is administered at least 1 week after the dose or dosing that occurred just prior to the repeat dose or dosing. In some embodiments of any one of the methods provided herein, the repeat dose or dosing is administered at least 1 month after the dose or dosing that occurred just prior to the repeat dose or dosing. Repeat dosing is considered to be efficacious if it results in a beneficial effect for the subject. Preferably, efficacious repeat dosing results in a beneficial effect in conjunction with reduced immune response, such as to the viral vector and/or to the encoded transgene.

Exemplary modes of administration include oral, rectal, transmucosal, intranasal, inhalation (e.g., via an aerosol), buccal (e.g., sublingual), vaginal, intrathecal, intraocular, transdermal, in utero (or in ovo), parenteral (e.g., intravenous, subcutaneous, intradermal, intramuscular [including administration to skeletal, diaphragm and/or cardiac muscle], intradermal, intrapleural, intracerebral, and intraarticular), topical (e.g., to both skin and mucosal surfaces, including airway surfaces, and transdermal administration), intralymphatic, and the like, as well as direct tissue or organ injection (e.g., to liver, skeletal muscle, cardiac muscle, diaphragm muscle or brain). Administration can also be to a tumor (e.g., in or near a tumor or a lymph node). The most suitable route in any given case will depend on the nature and severity of the condition being treated and/or prevented and on the nature of the particular vector that is being used.

Administration to skeletal muscle according to the present invention includes but is not limited to administration to skeletal muscle in the limbs (e.g., upper arm, lower arm, upper leg, and/or lower leg), back, neck, head (e.g., tongue), thorax, abdomen, pelvis/perineum, and/or digits. Suitable skeletal muscles include but are not limited to abductor digiti minimi (in the hand), abductor digiti minimi (in the foot), abductor hallucis, abductor ossis metatarsi quinti, abductor pollicis brevis, abductor pollicis longus, adductor brevis, adductor hallucis, adductor longus, adductor magnus, adductor pollicis, anconeus, anterior scalene, articularis genus, biceps brachii, biceps femoris, brachialis, brachioradialis, buccinator, coracobrachialis, corrugator supercilii, deltoid, depressor anguli oris, depressor labii inferioris, digastric, dorsal interossei (in the hand), dorsal interossei (in the foot), extensor carpi radialis brevis, extensor carpi radialis longus, extensor carpi ulnaris, extensor digiti minimi, extensor digitorum, extensor digitorum brevis, extensor digitorum longus, extensor hallucis brevis, extensor hallucis longus, extensor indicis, extensor pollicis brevis, extensor pollicis longus, flexor carpi radialis, flexor carpi ulnaris, flexor digiti minimi brevis (in the hand), flexor digiti minimi brevis (in the foot), flexor digitorum brevis, flexor digitorum longus, flexor digitorum profundus, flexor digitorum superficialis, flexor hallucis brevis, flexor hallucis longus, flexor pollicis brevis, flexor pollicis longus, frontalis, gastroenemius, geniohyoid, gluteus maximus, gluteus medius, gluteus minimus, gracilis, iliocostalis cervicis, iliocostalis lumborum, iliocostalis thoracis, illiacus, inferior gemellus, inferior oblique, inferior rectus, infraspinatus, interspinalis, intertransversi, lateral pterygoid, lateral rectus, latissimus dorsi, levator anguli oris, levator labii superioris, levator labii superioris alaeque nasi, levator palpebrae superioris, levator scapulae, long rotators, longissimus capitis, longissimus cervicis, longissimus thoracis, longus capitis, longus colli, lumbricals (in the hand), lumbricals (in the foot), masseter, medial pterygoid, medial rectus, middle scalene, multifidus, mylohyoid, obliquus capitis inferior, obliquus capitis superior, obturator externus, obturator intermus, occipitalis, omohyoid, opponens digiti minimi, opponens pollicis, orbicularis oculi, orbicularis oris, palmar interossei, palmaris brevis, palmaris longus, pectineus, pectoralis major, pectoralis minor, peroneus brevis, peroneus longus, peroneus tertius, piriformis, plantar interossei, plantaris, platysma, popliteus, posterior scalene, pronator quadratus, pronator teres, psoas major, quadratus femoris, quadratus plantae, rectus capitis anterior, rectus capitis lateralis, rectus capitis posterior major, rectus capitis posterior minor, rectus femoris, rhomboid major, rhomboid minor, risorius, sartorius, scalenus minimus, semimembranosus, semispinalis capitis, semispinalis cervicis, semispinalis thoracis, semitendinosus, serratus anterior, short rotators, soleus, spinalis capitis, spinalis cervicis, spinalis thoracis, splenius capitis, splenius cervicis, sternocleidomastoid, sternohyoid, sternothyroid, stylohyoid, subclavius, subscapularis, superior gemellus, superior oblique, superior rectus, supinator, supraspinatus, temporalis, tensor fascia lata, teres major, teres minor, thoracis, thyrohyoid, tibialis anterior, tibialis posterior, trapezius, triceps brachii, vastus intermedius, vastus lateralis, vastus medialis, zygomaticus major, and zygomaticus minor, and any other suitable skeletal muscle as known in the art.

The virus vector and/or capsid can be delivered to skeletal muscle by intravenous administration, intra-arterial administration, intraperitoneal administration, limb perfusion, (optionally, isolated limb perfusion of a leg and/or arm; see e.g., Arruda et al. (2005) *Blood* 105:3458-3464), and/or direct intramuscular injection. In particular embodiments, the virus vector and/or capsid is administered to a limb (arm and/or leg) of a subject (e.g., a subject with muscular dystrophy such as DMD) by limb perfusion, optionally isolated limb perfusion (e.g., by intravenous or intra-articular administration). In embodiments of the invention, the virus vectors and/or capsids of the invention can advantageously be administered without employing "hydrodynamic" techniques. Tissue delivery (e.g., to muscle) of vectors is often enhanced by hydrodynamic techniques (e.g., intravenous/intravenous administration in a large volume), which increase pressure in the vasculature and facilitate the ability of the vector to cross the endothelial cell barrier. In particular embodiments, the viral vectors and/or capsids of the invention can be administered in the absence of hydrodynamic techniques such as high volume infusions and/or elevated intravascular pressure (e.g., greater than normal systolic pressure, for example, less than or equal to a 5%, 10%, 15%, 20%, 25% increase in intravascular pressure over normal systolic pressure). Such methods may reduce or avoid the side effects associated with hydrodynamic techniques such as edema, nerve damage and/or compartment syndrome.

Administration to cardiac muscle includes administration to the left atrium, right atrium, left ventricle, right ventricle and/or septum. The virus vector and/or capsid can be delivered to cardiac muscle by intravenous administration, intra-arterial administration such as intra-aortic administration, direct cardiac injection (e.g., into left atrium, right atrium, left ventricle, right ventricle), and/or coronary artery perfusion.

Administration to diaphragm muscle can be by any suitable method including intravenous administration, intra-arterial administration, and/or intra-peritoneal administration.

Delivery to a target tissue can also be achieved by delivering a depot comprising the virus vector and/or capsid. In representative embodiments, a depot comprising the virus vector and/or capsid is implanted into skeletal, cardiac and/or diaphragm muscle tissue or the tissue can be contacted with a film or other matrix comprising the virus vector and/or capsid. Such implantable matrices or substrates are described, e.g., in U.S. Pat. No. 7,201,898.

In particular embodiments, a virus vector and/or virus capsid according to the present invention is administered to skeletal muscle, diaphragm muscle and/or cardiac muscle (e.g., to treat and/or prevent muscular dystrophy, heart disease [for example, PAD or congestive heart failure]).

In representative embodiments, the invention is used to treat and/or prevent disorders of skeletal, cardiac and/or diaphragm muscle.

In a representative embodiment, the invention provides a method of treating and/or preventing muscular dystrophy in a subject in need thereof, the method comprising: administering a treatment or prevention effective amount of a virus vector of the invention to a mammalian subject, wherein the virus vector comprises a heterologous nucleic acid encoding dystrophin, a mini-dystrophin, a micro-dystrophin, myostatin propeptide, follistatin, activin type II soluble receptor, IGF-1, anti-inflammatory polypeptides such as the Ikappa B dominant mutant, sarcospan, utrophin, a micro-dystrophin, laminin-α2, α-sarcoglycan, β-sarcoglycan, γ-sarcoglycan, δ-sarcoglycan, IGF-1, an antibody or antibody fragment against myostatin or myostatin propeptide, and/or RNAi against myostatin. In particular embodiments, the virus vector can be administered to skeletal, diaphragm and/or cardiac muscle as described elsewhere herein.

Alternatively, the invention can be practiced to deliver a nucleic acid to skeletal, cardiac or diaphragm muscle, which is used as a platform for production of a polypeptide (e.g., an enzyme) or functional RNA (e.g., RNAi, microRNA, antisense RNA) that normally circulates in the blood or for systemic delivery to other tissues to treat and/or prevent a disorder (e.g., a metabolic disorder, such as diabetes [e.g., insulin], hemophilia [e.g., Factor IX or Factor VIII], a mucopolysaccharide disorder [e.g., Sly syndrome, Hurler Syndrome, Scheie Syndrome, Hurler-Scheie Syndrome, Hunter's Syndrome, Sanfilippo Syndrome A, B, C, D, Morquio Syndrome, Maroteaux-Lamy Syndrome, etc.] or a lysosomal storage disorder such as Gaucher's disease [glucocerebrosidase] or Fabry disease [α-galactosidase A] or a glycogen storage disorder such as Pompe disease [lysosomal acid α glucosidase]). Other suitable proteins for treating and/or preventing metabolic disorders are described herein. The use of muscle as a platform to express a nucleic acid of interest is described in U.S. Patent Publication No. 20020192189.

Thus, as one aspect, the invention further encompasses a method of treating and/or preventing a metabolic disorder in a subject in need thereof, the method comprising: administering a treatment or prevention effective amount of a virus vector of the invention to skeletal muscle of a subject, wherein the virus vector comprises a heterologous nucleic acid encoding a polypeptide, wherein the metabolic disorder is a result of a deficiency and/or defect in the polypeptide. Illustrative metabolic disorders and heterologous nucleic acids encoding polypeptides are described herein. Optionally, the polypeptide is secreted (e.g., a polypeptide that is a secreted polypeptide in its native state or that has been engineered to be secreted, for example, by operable association with a secretory signal sequence as is known in the art). Without being limited by any particular theory of the invention, according to this embodiment, administration to the skeletal muscle can result in secretion of the polypeptide into the systemic circulation and delivery to target tissue(s). Methods of delivering virus vectors to skeletal muscle are described in more detail herein.

The invention can also be practiced to produce antisense RNA, RNAi or other functional RNA (e.g., a ribozyme) for systemic delivery.

The invention also provides a method of treating and/or preventing congenital heart failure or PAD in a subject in need thereof, the method comprising administering a treatment or prevention effective amount of a virus vector of the invention to a mammalian subject, wherein the virus vector comprises a heterologous nucleic acid encoding, for example, a sarcoplasmic endoreticulum $Ca^{2+}$-ATPase (SERCA2a), an angiogenic factor, phosphatase inhibitor I (I-1) and fragments thereof (e.g., I1C), RNAi against phospholamban; a phospholamban inhibitory or dominant-negative molecule such as phospholamban S16E, a zinc finger protein that regulates the phospholamban gene, β2-adrenergic receptor, β2-adrenergic receptor kinase (BARK), PI3 kinase, calsarcan, a β-adrenergic receptor kinase inhibitor (βARKct), inhibitor 1 of protein phosphatase 1 and fragments thereof (e.g., I1C), S100A1, parvalbumin, adenylyl cyclase type 6, a molecule that effects G-protein coupled receptor kinase type 2 knockdown such as a truncated constitutively active bARKct, Pim-1, PGC-1α, SOD-1, SOD-2, EC-SOD, kallikrein, HIF, thymosin-β4, mir-1, mir-133, mir-206, mir-208 and/or mir-26a.

In some embodiments, the invention further encompasses a method of treating and/or preventing a congenital neurodegenerative disorder (e.g., monogenic neurodegenerative disorder) in a subject in need thereof, the method comprising: administering a treatment or prevention effective amount of a virus vector of the invention to neural tissue (e.g., neuronal cells) of a subject, wherein the virus vector comprises a heterologous nucleic acid encoding a polypeptide, wherein the congenital neurodegenerative disorder is a result of a deficiency and/or defect in the polypeptide. Illustrative congenital neurodegenerative disorders and heterologous nucleic acids encoding polypeptides are described herein. Optionally, the polypeptide is secreted (e.g., a polypeptide that is a secreted polypeptide in its native state or that has been engineered to be secreted, for example, by operable association with a secretory signal sequence as is known in the art). In some embodiments, the subject is a human. In some embodiments, the subject is in utero. In some embodiments, the subject has or is at risk for a congenital (e.g., monogenic) neurodegenerative disorder. In some embodiments, the subject has or is at risk for mucopolysacharidosis or leukodystrophy.

Injectables can be prepared in conventional forms, either as liquid solutions or suspensions, solid forms suitable for solution or suspension in liquid prior to injection, or as emulsions. Alternatively, one may administer the virus vector and/or virus capsids of the invention in a local rather than systemic manner, for example, in a depot or sustained-release formulation. Further, the virus vector and/or virus capsid can be delivered adhered to a surgically implantable matrix (e.g., as described in U.S. Patent Publication No. 20040013645).

The virus vectors and/or virus capsids disclosed herein can be administered to the lungs of a subject by any suitable means, optionally by administering an aerosol suspension of respirable particles comprised of the virus vectors and/or virus capsids, which the subject inhales. The respirable particles can be liquid or solid. Aerosols of liquid particles comprising the virus vectors and/or virus capsids may be produced by any suitable means, such as with a pressure-driven aerosol nebulizer or an ultrasonic nebulizer, as is known to those of skill in the art. See e.g., U.S. Pat. No. 4,501,729. Aerosols of solid particles comprising the virus vectors and/or capsids may likewise be produced with any solid particulate medicament aerosol generator, by techniques known in the pharmaceutical art.

The virus vectors and virus capsids can be administered to tissues of the central nervous system (CNS) (e.g., brain, eye) and may advantageously result in broader distribution of the virus vector or capsid than would be observed in the absence of the present invention.

In particular embodiments, the delivery vectors of the invention may be administered to treat diseases of the CNS, including genetic disorders, neurodegenerative disorders, psychiatric disorders and tumors. Illustrative diseases of the CNS include, but are not limited to Alzheimer's disease, Parkinson's disease, Huntington's disease, Canavan disease, Leigh's disease, Refsum disease, Tourette syndrome, primary lateral sclerosis, amyotrophic lateral sclerosis, progressive muscular atrophy, Pick's disease, muscular dystrophy, multiple sclerosis, myasthenia gravis, Binswanger's disease, trauma due to spinal cord or head injury, Tay Sachs disease, Lesch-Nyan disease, epilepsy, cerebral infarcts, psychiatric disorders including mood disorders (e.g., depression, bipolar affective disorder, persistent affective disorder, secondary mood disorder), schizophrenia, drug dependency (e.g., alcoholism and other substance dependencies), neuroses (e.g., anxiety, obsessional disorder, somatoform disorder, dissociative disorder, grief, post-partum depression), psychosis (e.g., hallucinations and delusions), dementia, paranoia, attention deficit disorder, psychosexual disorders, sleeping disorders, pain disorders, eating or weight disorders (e.g., obesity, cachexia, anorexia nervosa, and bulimia) cancers and tumors (e.g., pituitary tumors) of the CNS, and congenital neurodegenerative disorders such as mucopolysacharidosis (including, but not limited to, Mucopolysaccharidosis Type I (also known as Hurler syndrome, Hurler-Scheie Syndrome, or Scheie syndrome, IDUA, alpha-L-iduronidase), Mucopolysaccharidosis Type II (also known as Hunter syndrome, IDS, I2L enzyme), Mucopolysaccharidosis Type III (also known as Sanfilippo syndrome, GNS [N-acetylglucosamine-6-sulfatase], HGSNAT [heparan-alpha-glucosaminide N-acetyltransferase], NAGLU [alpha-N-acetylglucosaminidase], and/or SGSH [sulfamidase]), Mucopolysaccharidosis Type IV (also known as Morquio syndrome, GALNS [galatosamine (N-acetyl)-6-sulfatase] and/or GLB1 [beta-galactosidase]), Mucopolysaccharidosis Type V (also known as Scheie syndrome, now a subgroup of type I, also IDUA, alpha-L-iduronidase), Mucopolysaccharidosis Type VI (also known as Maroteaux-Lamy syndrome, ARSB, arylsulfatase B), Mucopolysaccharidosis Type VII (also known as Sly syndrome, GUSB, beta-glucuronidase), Mucopolysaccharidosis Type IX (also known as Natowicz syndrome, HYAL1, hyaluronidase) and/or leukodystrophy (including, but not limited to, adult-onset autosomal dominant leukodystrophy (ADLD; LMNB1, lamin B1), Aicardi-Goutieres syndrome (TREX1, RNASEHSB, RNASEH2C, and/or RNASEH2A), Alexander disease (FRAP, glial fibrillary acidic protein), CADASIL (Notch3), Canavan disease (ASPA, aspartoacylase), CARASIL (HTRA1, serine protease HTRA1), cerebrotendinous xanthomatosis ("CTX," CYP27A1, sterol 27-hydroxylase) childhood ataxia and cerebral hypomyelination (CACH)/vanishing white matter disease (VWMD) (eIF2B, eukaryotic initiation factor 2B), Fabry disease (GLA, alpha-galactosidase A), fucosidosis (FUCA1, alpha-L-fucosidase), GM1 gangliosidosis (GLB1, beta-galactosidase), L-2-hydroxyglutaric aciduria (L2HDGH, L-2-hydroxyglutarate dehydrogenase), Krabbe disease (GALC, galactocerebrosidase), megalencephalic leukoencephalopathy with subcortical cysts ("MLC," MLC1 and/or HEPACAM), metachromatic leukodystrophy (ASA, arylsulphatase A), multiple sulfatase deficiency ("MSD," SUMF1, sulfatase modifying factor 1 affecting all sulfatase enzymes), Pelizaeus-Merzbacher disease (also known as "X-linked spastic paraplegia," PLP1 [X-linked proteolipid protein 1] and/or GJA12 [gap junction protein 12]), Pol III-Related Leukodystrophies (POLR3A and/or POLR3B), Refsum disease (PHYH, [phytanoyl-CoA hydroxylase] and/or Pex7 [PHYH importer into peroxisomes]), salla disease (also known as "free sialic acid storage disease," SLC17A5, sialic acid transporter), Sjogren-Larsson syndrome (ALDH3A2, aldehyde dehydrogenase), X-linked adrenoleukodystrophy ("ALD," ABCD1, peroxisomal ATPase Binding Cassette protein), Zellweger syndrome spectrum disorders (also known as peroxisomal biogenesis disorders, PEX1, PEX2, PEX3, PEX4, PEX5, PEX10, PEX11B, PEX12, PEX13, PEX14, PEX16, PEX19, PEX26), and the like.

Disorders of the CNS include ophthalmic disorders involving the retina, posterior tract, and optic nerve (e.g., retinitis pigmentosa, diabetic retinopathy and other retinal degenerative diseases, uveitis, age-related macular degeneration, glaucoma).

Most, if not all, ophthalmic diseases and disorders are associated with one or more of three types of indications: (1) angiogenesis, (2) inflammation, and (3) degeneration. The delivery vectors of the present invention can be employed to deliver anti-angiogenic factors; anti-inflammatory factors; factors that retard cell degeneration, promote cell sparing, or promote cell growth and combinations of the foregoing.

Diabetic retinopathy, for example, is characterized by angiogenesis. Diabetic retinopathy can be treated by delivering one or more anti-angiogenic factors either intraocularly (e.g., in the vitreous) or periocularly (e.g., in the sub-Tenon's region). One or more neurotrophic factors may also be co-delivered, either intraocularly (e.g., intravitreally) or periocularly.

Uveitis involves inflammation. One or more anti-inflammatory factors can be administered by intraocular (e.g., vitreous or anterior chamber) administration of a delivery vector of the invention.

Retinitis pigmentosa, by comparison, is characterized by retinal degeneration. In representative embodiments, retinitis pigmentosa can be treated by intraocular (e.g., vitreal administration) of a delivery vector encoding one or more neurotrophic factors.

Age-related macular degeneration involves both angiogenesis and retinal degeneration. This disorder can be treated by administering the inventive delivery vectors encoding one or more neurotrophic factors intraocularly (e.g., vitreous) and/or one or more anti-angiogenic factors intraocularly or periocularly (e.g., in the sub-Tenon's region).

Glaucoma is characterized by increased ocular pressure and loss of retinal ganglion cells. Treatments for glaucoma include administration of one or more neuroprotective agents that protect cells from excitotoxic damage using the inventive delivery vectors. Such agents include N-methyl-D-aspartate (NMDA) antagonists, cytokines, and neurotrophic factors, delivered intraocularly, optionally intravitreally.

In other embodiments, the present invention may be used to treat seizures, e.g., to reduce the onset, incidence and/or severity of seizures. The efficacy of a therapeutic treatment for seizures can be assessed by behavioral (e.g., shaking, ticks of the eye or mouth) and/or electrographic means (most seizures have signature electrographic abnormalities). Thus, the invention can also be used to treat epilepsy, which is marked by multiple seizures over time.

In one representative embodiment, somatostatin (or an active fragment thereof) is administered to the brain using a delivery vector of the invention to treat a pituitary tumor. According to this embodiment, the delivery vector encoding somatostatin (or an active fragment thereof) is administered by microinfusion into the pituitary. Likewise, such treatment can be used to treat acromegaly (abnormal growth hormone secretion from the pituitary). The nucleic acid sequences (e.g., GenBank Accession No. J00306) and amino acid sequences (e.g., GenBank Accession No. P01166; contains processed active peptides somatostatin-28 and somatostatin-14) of somatostatins are known in the art.

In particular embodiments, the vector can comprise a secretory signal as described, e.g., in U.S. Pat. No. 7,071,172.

In representative embodiments of the invention, the virus vector and/or virus capsid is administered to the CNS (e.g., to the brain or to the eye). The virus vector and/or capsid may be introduced into the spinal cord, brainstem (medulla oblongata, pons), midbrain (hypothalamus, thalamus, epithalamus, pituitary gland, substantia nigra, pineal gland), cerebellum, telencephalon (corpus striatum, cerebrum including the occipital, temporal, parietal and frontal lobes, cortex, basal ganglia, hippocampus and portaamygdala), limbic system, neocortex, corpus striatum, cerebrum, and/or inferior colliculus. The virus vector and/or capsid may also be administered to different regions of the eye such as the retina, cornea and/or optic nerve.

The virus vector and/or capsid may be delivered into the cerebrospinal fluid (e.g., by lumbar puncture) for more disperse administration of the delivery vector. The virus vector and/or capsid may further be administered intravascularly to the CNS in situations in which the blood-brain barrier has been perturbed (e.g., brain tumor or cerebral infarct).

The virus vector and/or capsid can be administered to the desired region(s) of the CNS by any route known in the art, including but not limited to, intrathecal, intracerebral, intraventricular, intravenous (e.g., in the presence of a sugar such as mannitol), intranasal, intra-aural, intra-ocular (e.g., intra-vitreous, sub-retinal, anterior chamber) and peri-ocular (e.g., sub-Tenon's region) delivery as well as intramuscular delivery with retrograde delivery to motor neurons.

In some embodiments, the virus vector or composition of the present invention may be delivered via an enteral, parenteral, intrathecal, intracisternal, intracerebral, intraventricular, intranasal, intra-aural, intra-ocular, peri-ocular, intrarectal, intramuscular, intraperitoneal, intravenous, oral, sublingual, subcutaneous and/or transdermal route. In some embodiments, the virus vector or composition of the present invention may be delivered intracranially and/or intraspinally.

In particular embodiments, the virus vector and/or capsid is administered in a liquid formulation by direct injection (e.g., stereotactic injection) to the desired region or compartment in the CNS. In other embodiments, the virus vector and/or capsid may be provided by topical application to the desired region or by intra-nasal administration of an aerosol formulation. Administration to the eye may be by topical application of liquid droplets. As a further alternative, the virus vector and/or capsid may be administered as a solid, slow-release formulation (see, e.g., U.S. Pat. No. 7,201,898).

In yet additional embodiments, the virus vector can used for retrograde transport to treat and/or prevent diseases and disorders involving motor neurons (e.g., amyotrophic lateral sclerosis (ALS); spinal muscular atrophy (SMA), etc.). For example, the virus vector can be delivered to muscle tissue from which it can migrate into neurons.

The present invention may be as defined in any one of the following numbered paragraphs.

1. An adeno-associated virus (AAV) capsid protein which comprises an AAV2.5 capsid protein comprising one or more amino acid substitutions that introduce a new glycan binding site (e.g., which does not contain a substitution at the position corresponding to amino acid 267 of AAV2.5, or does not contain a serine at the position corresponding to amino acid 267 of AAV2.5).

2. The AAV capsid protein of paragraph 1, wherein the one or more amino acid substitutions comprise:
   a) SQAGASDIRDQSR464-476S$X_1$AG$X_2$S$X_3$x$_4$x$_5$x$_6$Q$X_7$R, wherein $X_{1-7}$ can be any amino acid; and
   b) EYSW500-503E$X_8$$X_9$W, wherein $X_{8-9}$ can be any amino acid.

3. The AAV capsid protein of paragraph 2, wherein:
   $X_1$ is V or a conservative substitution thereof;
   $X_2$ is P or a conservative substitution thereof;
   $X_3$ is N or a conservative substitution thereof;
   $X_4$ is M or a conservative substitution thereof;
   $X_5$ is A or a conservative substitution thereof;
   $X_6$ is V or a conservative substitution thereof;
   $X_7$ is G or a conservative substitution thereof;
   $X_8$ is F or a conservative substitution thereof; and/or
   $X_9$ is A or a conservative substitution thereof.

4. The AAV capsid protein of paragraph 3, wherein $X_1$ is V, $X_2$ is P, $X_3$ is N, $X_4$ is M, $X_5$ is A, $X_6$ is V, $X_7$ is G, $X_8$ is F, and $X_9$ is A, wherein the new glycan binding site is a galactose binding site.

5. The AAV capsid protein of any one of paragraphs 1-4, wherein the amino acid sequence of the AAV2.5 capsid protein is SEQ ID NO:1 or a functional derivative thereof (e.g., which does not contain a substitution at the position corresponding to amino acid 267 of AAV2.5, or does not contain a serine at the position corresponding to amino acid 267 of AAV2.5).

6. The AAV capsid protein of any one of paragraphs 1-5, wherein the amino acid sequence is SEQ ID NO:2 or a functional derivative thereof (e.g., which does not contain a substitution at the position corresponding to amino acid 267 of AAV2.5, or does not contain a serine at the position corresponding to amino acid 267 of AAV2.5).

7. A viral capsid comprising the AAV capsid protein of any one of paragraphs 1-6.

8. A virus vector comprising:
   (a) the viral capsid of paragraph 7; and
   (b) a nucleic acid comprising at least one terminal repeat sequence,
   wherein the nucleic acid is encapsidated by the viral capsid.

8a. The virus vector of paragraph 8, that exhibits substantially increased transduction in one or more of human fibroblasts, neuronal and glial cells as compared to AAV rh10, as measured by Relative Luciferase unit.

8b. The virus vector of any one of paragraphs 8 or 8a that evades pre-existing neutralizing antibodies in a subject.

9. A composition comprising the AAV capsid protein of any one of paragraphs 1-6, the viral capsid of paragraph 7 and/or the virus vector of any one of paragraphs 8-8b, in a pharmaceutically acceptable carrier.

10. A method of introducing a nucleic acid into a cell, comprising contacting the cell with the virus vector of any one of paragraphs 8-8b.

11. The method of paragraph 10, wherein the cell is in neural tissue.

12. The method of paragraph 11, wherein the cell is a neuron or a glial cell.

13. The method of paragraph 12, wherein the glial cell is an astrocyte.

14. The method of paragraph 11, wherein the virus vector has enhanced transduction of neural tissue as compared to an AAV1, AAV2, AAV9, or AAV2.5 virus vector.

15. The method of any one of paragraphs 10-14, wherein the cell is in a subject.

16. The method of paragraph 15, wherein the subject is a human subject.

17. The method of paragraph 16, wherein the subject is a child.

18. The method of paragraph 17, wherein the child is an infant.

19. The method of paragraph 15 or 16, wherein the subject is in utero.

20. The method of any one of paragraphs 15-19, wherein the subject has a reduced immunologic profile when contacted with the virus vector of paragraph 8 as compared to when contacted with an AAV1, AAV2, AAV9, or AAV2.5 virus vector.

21. A method of treating a disease or disorder in a subject in need thereof, comprising introducing a therapeutic nucleic acid into a cell of the subject by administering to the subject the virus vector of any one of paragraphs 8-8b and/or the composition of paragraph 9, under conditions whereby the therapeutic nucleic acid is expressed in the cell of the subject.

22. The method of paragraph 21, wherein the subject is a human.

23. The method of paragraph 21 or 22, wherein the subject is in utero.

24. The method of any one of paragraphs 21-23, wherein the subject has or is at risk for a CNS disease or disorder.

25. The method of any one of paragraphs 21-23, wherein the subject has or is at risk for a congenital neurodegenerative disorder.

26. The method of any one of paragraphs 21-23, wherein the subject has or is at risk for adult-onset autosomal dominant leukodystrophy (ADLD), Aicardi-Goutieres syndrome, Alexander disease, CADASIL, Canavan disease, CARASIL, cerebrotendinous xanthomatosis childhood ataxia and cerebral hypomyelination (CACH)/vanishing white matter disease (VWMD), Fabry disease, fucosidosis. GM1 gangliosidosis, Krabbe disease, L-2-hydroxyglutaric aciduria megalencephalic leukoencephalopathy with subcortical cysts, metachromatic leukodystrophy, multiple sulfatase deficiency, Pelizaeus-Merzbacher disease, Pol III-Related Leukodystrophies, Refsum disease, salla disease (free sialic acid storage disease), Sjogren-Larsson syndrome, X-linked adrenoleukodystrophy, Zellweger syndrome spectrum disorders, Mucopolysaccharidosis Type I, Mucopolysaccharidosis Type II, Mucopolysaccharidosis Type III, Mucopolysaccharidosis Type IV, Mucopolysaccharidosis Type V, Mucopolysaccharidosis Type VI, Mucopolysaccharidosis Type VII, Mucopolysaccharidosis Type IX and any combination thereof.

27. The method of paragraph 21 or 22, wherein the subject has or is at risk of having pain associated with a disease or disorder.

28. The method of any one of paragraphs 21-27, wherein the virus vector or composition is delivered via an enteral, parenteral, intrathecal, intracisternal, intracerebral, intraventricular, intranasal, intra-aural, intra-ocular, peri-ocular, intrarectal, intramuscular, intraperitoneal, intravenous, oral, sublingual, subcutaneous and/or transdermal route.

29. The method of any one of paragraphs 21-27, wherein the virus vector or composition is delivered intracranially and/or intraspinally.

29a. The method of any one of paragraphs 15-29, wherein the virus vector is used for repeat dosing in the subject.

30. The AAV capsid protein, viral capsid, virus vector, composition or method of any one of paragraphs 1-29a, wherein Applicants disclaimer as follows: To the extent that any disclosure in PCT/US2020/029493 filed Apr. 23, 2020 falls within the invention as defined in any one or more of the claims of this application, or within any invention to be defined in amended claims that may in the future be filed in this application or in any patent derived therefrom, and to the extent that the laws of any relevant country or countries to which that or those claims apply provide that the disclosure of PCT/US2020/029493 is part of the state of the art against that or those claims in or for that or those countries, we hereby reserve the right to disclaim the said disclosure from the claims of the present application or any patent derived therefrom to the extent necessary to prevent invalidation of the present application or any patent derived therefrom. Without limitation, we state that the above reservation of a right of disclaimer applies at least to claims 1-29a as listed in this application and paragraphs 1-29a as set forth above.

Having described the present invention, the same will be explained in greater detail in the following examples, which are included herein for illustration purposes only and are not intended to be limiting to the invention.

EXAMPLES

Example 1: Rhesus Monkey in Utero Treatment of AAV2G9 and AAV2.5G9

Congenital monogenic neurodegenerative disorders such as mucopolysacharidosis and leukodystrophy are prime candidates for targeted gene therapy, but successful interventions must occur prior to physical and behavioral manifestations of disease. In some cases, disease initiation occurs early during development and therefore treatment must be considered prior to birth. This study compares the safety, efficiency, and cell tropism of a naturally occurring AAV serotype (AAV9) with two novel chimeric AAV vectors (AAV2G9 and AAV2.5G9 (amino acid sequence of the capsid is show in SEQ ID NO:2)) following in utero intracranial administration into primates in the early second trimester under ultrasound guidance. Tissues were harvested near term and transgene expression assessed by ex vivo bioluminescence imaging (BLI) and qPCR. BLI indicated high levels of firefly luciferase expression in the cerebral hemispheres and spinal cord with all vectors tested. qPCR was highly correlated with BLI findings. No adverse effects on fetal growth or development were observed. Tissues were within normal limits with expected populations of neurons, astrocytes, and oligodendrocytes confirmed by immunohistochemistry. These studies demonstrate the safety, efficacy, and tropism of chimeric AAV vectors for targeted gene therapy for congenital neurodegenerative disorders amenable to gene replacement strategies.

No adverse effects were detected sonographically or at fetal tissue harvest. Fetal body and organ weights at tissue harvest were within normal limits when compared to historical controls (N=36) (mean 465.1±16.8 historical control mean 484.1±14.2 g; FIG. 1). Brain weights were also comparable (mean 53.8±1.7 g) to concurrent (mean 55.5±1.9 g) and historical controls (mean 56.1±0.6 g).

Figure 2:
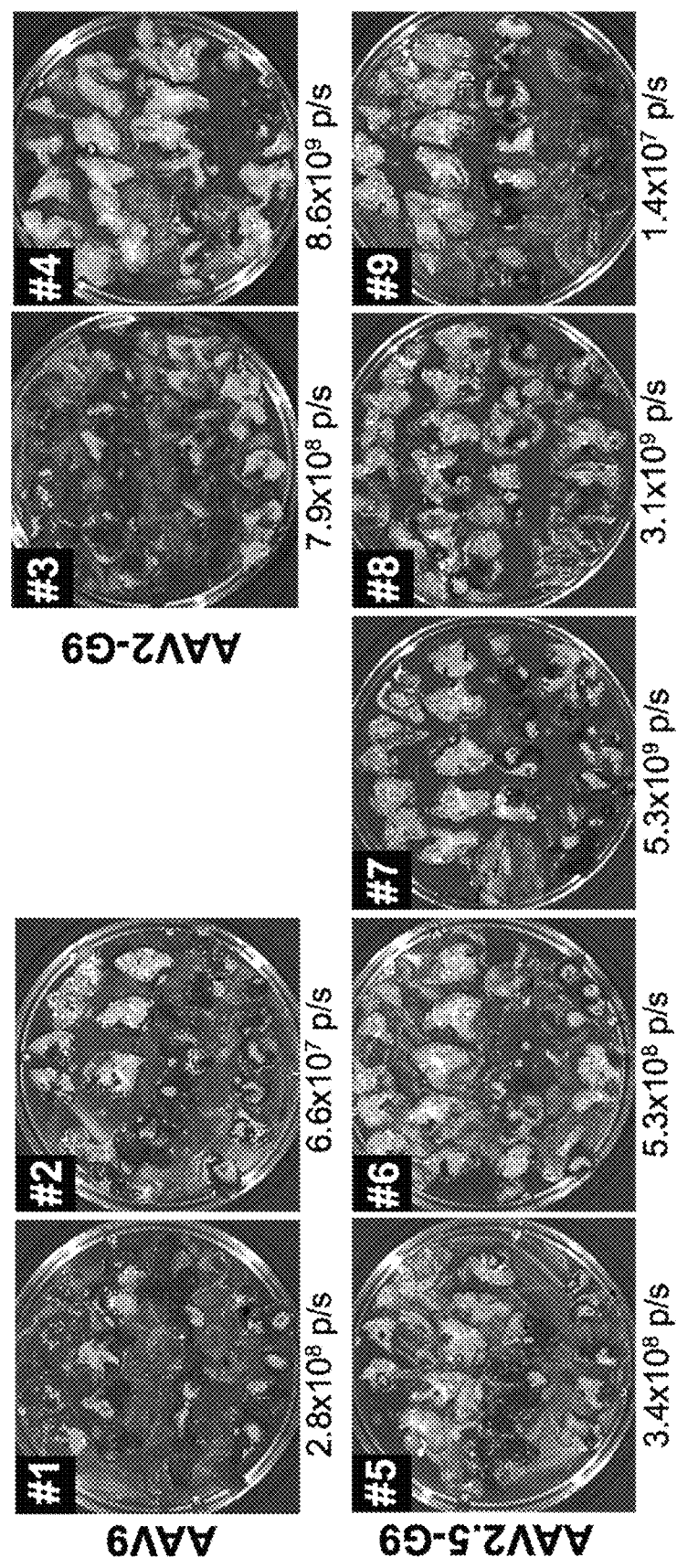
FIG. 2 shows detection of AAV-mediated firefly luciferase transduction and expression by bioluminescence. Individual sections of the right and left hemispheres (frontal, parietal, temporal, occipital lobes) from fetuses administered AAV9, AAV2G9, and AAV2.5G9 were imaged for bioluminescence. Each image corresponds to an animal number as noted in Table 3. Total bioluminescence is noted below each image in photons/second (p/s). Data are shown as mean±standard error of the mean. Significance was determined by Student's t-test analysis at p≤0.05.

Bioluminescence Imaging (BLI) Results. All fetuses administered AAV vectors were observed with high levels of firefly luciferase expression within the cerebral hemispheres and primarily correlated with the side of vector administration (FIG. 2). Fetuses administered AAV9 showed total bioluminescence of $2.8 \times 10^8$ p/s and $6.6 \times 10^8$ p/s in all brain lobes, and $7.9 \times 10^8$ p/s and $8.6 \times 10^9$ p/s was observed in fetuses administered AAV2G9. Fetuses administered AAV2.5G9 showed $1.4 \times 10^7$ to $5.3 \times 10^9$ p/s. Bioluminescence in individual brain lobes was in general greater with the chimeric vectors (AAV2G9, AAV2.5G9) when compared to AAV9 (Table 3). Firefly luciferase expression was also noted in the spinal cord. Very low or no bioluminescence was detected in tissues outside the central nervous system.

Vector Biodistribution Results. Vector biodistribution was assessed by qPCR of firefly luciferase copies/50,000 cells in the fetal brain (all lobes of the cerebral hemispheres, cerebellum), spinal cord, and peripheral tissues at tissue harvest (Table 4). Presence of the vector was detected in all AAV-treated brains (9/9) and in all regions of the spinal cord. Presence of the vector was greater for AAV2.5G9 in all brain and spinal cord regions compared to AAV2G9 and AAV9. Overall, luciferase copy numbers varied between individual animals (Table 4). Compared to bioluminescence, high vector genome copies were observed in the spinal cord. Very low or no vector genome was amplified by qPCR in tissues outside the central nervous system.

This study addressed the transduction efficiency and biodistribution of AAV9 and two novel chimeric AAV vectors, AAV2G9 and AAV2.5G9. Fetal brain development was shown to follow normal developmental patterns after intracranial administration demonstrating the safety of this approach and the AAV vectors studied. The chimeric vectors tested were shown to have robust transduction efficiency in all brain lobes, cerebellum, and spinal cord with single site administration.

AAV administration in utero has been demonstrated to be safe in the developing eye and ear of the mouse, which contain sensory photoreceptors and sensory hair cells that are post-mitotic and do not regenerate. Post-natal assessments of visual and auditory function revealed that in utero injection of AAV vectors encoding a GFP reporter gene had little to no effect on sensory thresholds. This is of significance because the death or dysfunction of even a small population of these sensory cells is readily detectable by functional analysis, therefore demonstrating a favorable safety profile. Further histological analysis revealed normal sensory cell density and morphology.

Rhesus Monkeys. All animal procedures conformed to the requirements of the Animal Welfare Act and protocols were approved prior to implementation by the Institutional Animal Care and Use Committee at the University of California, Davis. Activities related to animal care (diet, housing) were performed per California National Primate Research Center standard operating procedures. Normally cycling, adult female rhesus monkeys (*Macaca mulatta*) (N=9 gene transfer; 3 controls) with a history of prior pregnancy were bred and identified as pregnant according to established methods. Pregnancy in the rhesus monkey is divided into trimesters by 55-day increments, with the first trimester (0-55 days gestation), second trimester (56-110 days gestation), and third trimester (111-165 days gestation). Parturition typically occurs at 165±10 days gestational age.

Vector Administration and Fetal Monitoring. Dams were screened for AAV antibodies to select seronegative females for study assignment. AAV vectors were administered under ultrasound guidance in the early second trimester (65±5 days) using an intraventricular approach. Vector supernatant ($1 \times 10^{12}$ genome copies in 0.1 ml volume) was injected via intracranial administration into the right or left lateral ventricle (N=9). All pregnancies were sonographically monitored every 10-14 days during gestation according to established procedures.

Tissue Harvests. Hysterotomies were performed near term according to established protocols. All tissues were removed and imaged for firefly luciferase expression. The fetal brain was weighed then the right and left hemispheres (frontal, parietal, temporal, occipital lobes), cerebellum, and midbrain sectioned. Regions of the spinal cord (cervical, thoracic, lumbar) were also assessed post-BLI for molecular and histological analysis. Samples of all tissues were fixed in formalin for histological analysis or snap-frozen in liquid nitrogen for molecular analysis. Frozen samples were stored at ≤−80° C. until analysis.

BLI. BLI for luciferase expression was performed immediately following an intravenous injection of D-luciferin (100 mg/kg) (IVIS 200® imaging system with Living Image software, Xenogen, Alameda, Calif.). Bioluminescence was assessed using semi-quantitative methods (photons/cm$^2$; P/S) by placing regions of interest around sections with positive luminescence.

Vector Biodistribution. To quantify vector biodistribution, genomic DNA was isolated from snap-frozen tissues using the Gentra Puregene Tissue kit (Qiagen, Valencia, Calif.). qPCR was conducted with primers for firefly luciferase to quantify vector presence and with the housekeeping gene epsilon-globin (Life Technologies) as an internal control for DNA isolation and PCR reactions. Real-Time qPCR analysis was run in 96 well optical plates using the 7900 ABI Sequence Detection System and TaqMan Universal PCR Master Mix (Applied Biosystems). Genomic DNA expression was quantified relative to the housekeeping gene to normalize the amount of sample DNA.

Immunohistochemistry. Formalin-fixed paraffin sections of the cerebellum and right and left frontal, parietal, temporal, and occipital lobes were assessed by hematoxylin and eosin (H&E) staining to evaluate tissue morphology. IHC was performed with markers of neurons (Neuro-Chrom™ pan-neuronal marker, EMD Millipore), astrocytes (Glial fibrillary acidic protein, Abcam), or oligodendrocytes (Cyclic-nucleotide phosphodiesterase, Abcam) according to established protocols. Briefly, sections were deparaffinized with xylene, then rehydrated in graded ethanol. Heat-mediated antigen retrieval was performed in citrate buffer prior to incubation with primary antibodies overnight at 4° C. Secondary antibodies were applied for 1 h at room temperature (AlexaFluor-488, Life Technologies) for visualization. ProLong Gold antifade reagent with 4',6-diamidino-2-phenylindole, dihydrochloride (DAPI; Life Technologies) was used for mounting and to identify nuclei (Molecular Probes).

RNA in situ hybridization. Luciferase reporter RNA was visualized with the RNAscope® 2.5 Assay system (Advanced Cell Diagnostics, Hayward, Calif.) following the protocol described by the manufacturer. Target probes included luciferase (luc2) to visualize vector presence and FOX3 to visualize neurons. Negative control probes were targeted against the bacterial gene dapB while positive control probes targeted housekeeping genes Polr2a and PPIB. Sections were mounted with VectaMount (Vector Laboratories Inc, Burlingame, Calif.) and visualized with an Olympus BX61 microscope.

Example 2: AAV2.5G9 Chimera Retains Activities of AAV2.5

Preliminary analysis shown in Example 1 has indicated that the AAV2.5G9 chimera retains the various activities of the AAV2.5 chimera, such as the transduction of skeletal muscle, heparin binding, acquisition of a distinct immunological profile, reduced liver tropism, and neurologic cell tropism (neurons and glial cells such as astrocytes). This preliminary analysis will be confirmed by future experiments, examples of which are provided below.

Transduce Skeletal Muscle

The AAV2.5G9 A267 variant (e.g., SEQ ID NO:2) will be evaluated for the ability to transduce skeletal muscle by the following experiments. Following injection of $1\times10^{10}$ genome containing viral particles into the gastrocnemius muscle of BALB/c mice and compared to control AAV serotypes AAV2.5 and AAV2. Each mouse is imaged at 7, 14, 28, 42, and 95 days post injection. The virus used in this experiment is purified using heparin HPLC or cesium chloride gradients. The amount of light emitted from each animal is calculated using CMIR_image software. The regions of interest (ROI) from each leg are defined and used to calculate total photons emitted. Data are to be represented as an average of all 6 limbs. The AAV2.5G9 A267 variant exhibits comparable to greater muscle transduction than AAV2.5 and/or AAV2.5G9 A267S, and both AAV2.5G9 A267 and AAV2.5 exhibit much higher muscle transduction than AAV2.

Heparin Binding

The ability of the different variants to be purified by heparin will also be examined by the following experiments. AAV2.5G9 A267 is compared to the AAV2.5, AAV2.5G9 A267S and AAV2 serotypes. Equivalent particles of each AAV variant are applied to heparin agarose type 1 and allowed to bind. The columns are washed with PBS, followed by elution in sodium chloride. The number of particles present in the flow thru, washes and elutions are then determined via dot blot hybridization. Data are to be depicted as percentage of unbound particles (wash and flow thru) and bound (elution). As in prior experiments (U.S. Pat. No. 9,012,224) the AAV2.5 variant exhibits heparin binding profiles similar to AAV2. AAV2.5G9 A267 also exhibits a similar heparin binding profile to that of AAV2 and AAV2.5, indicating that the grafting of the Gal binding pocket onto the AAV2.5 serotype preserves this binding activity and also preserves receptor binding involved in cell tropism.

Immunological Profile

Similar to other non-enveloped viruses, high doses of AAV generate neutralizing antibody that prevents repeated dosing. With the advent of new serotypes, repeat administration is possible. To explore the ability to avoid a pre-existing immune response to AAV1, AAV2 and/or AAV9, the chimeric AAV2.5G9 A267 vector will be tested for transgene expression in vitro after exposure to serum from animals pre-exposed to different AAV serotypes (1, 2, and 2.5, 9 respectively) by the following experiments.

To generate animals with a robust immune response to AAV virion shell, $4\times10^{10}$ particles of AAV serotype 1, 2, 2.5, 2.5G9, and 9 vector are independently injected intramuscularly in C57blk6 mice. Four weeks post-injection, blood is isolated and serum collected. Serum from these animals is then used in a neutralizing antibody assay using 293 cells and AAV specific serotype vectors expressing GFP as a reporter gene. In this assay, serum is sequentially diluted and then mixed with a known amount of serotype specific vector ($1\times10^8$ particles) at 4° C. for 2 hr. This mixture of serum and vector is then added to 293 cells in 24-well plates in the presence of adenovirus helper virus at a multiplicity of infection of 5. Under these conditions, green fluorescent protein (GFP) expression is a measure of serotype-specific vector ability to infect cells in the presence of neutralizing antibodies. The neutralizing antibody titer is then calculated as the highest dilution where GFP expression is 50% or less than control vector (without pre-mixture with serotype specific serum).

Results will indicate that animals pre-exposed to AAV1 can neutralize AAV1 GFP transduction (e.g., with dilutions as high as 1:1000). However this serotype 1 specific neutralizing antibody requires more mouse serum to neutralize AAV chimeric 2.5 (e.g., 1:100 dilution), and AAV chimeric 2.5G9 A267. More importantly, this observation is true for mouse sera obtained from animals pre-exposed to AAV serotype 2 virion shells. In this assay, only after sera are diluted 1:10,000 is 50% GFP transduction observed when compared to AAV2 control. However, for chimeric 2.5 and 2.5G9, 50% GFP transduction is observed with far less dilution (e.g., only 1:100 dilution) of this mouse serum. Since only 0.6% of the amino acid changes differ from AAV2 in this chimeric vector, these alterations have profound effects on the ability of pre-existing AAV2 neutralizing antibody to recognize the AAV2.5 and AAV2.5G9 A267 capsid shell. Animals pre-exposed to 2.5 and AAV2.5G9 A267 and then assayed for neutralizing activity against AAV 1, 2, 2.5, 2.5G9 A267 and 9 yields expected results, with highest dilution required for the 2.5 and 2.5G9 A267 vector (e.g., 1:8000) followed by lower dilution (e.g., 1:1000) for AAV2 and even lower dilution (e.g., 1:100) for AAV serotype 1, respectively.

Similarly, animals pre-exposed to AAV9 can neutralize AAV9 GFP transduction with dilutions as high as 1:1000. However this serotype 9 specific neutralizing antibody will require more mouse serum to neutralize AAV chimeric 2.5G9 A267 (e.g., 1:100 dilution). More importantly, this observation is true for mouse sera obtained from animals pre-exposed to AAV serotype 9 virion shells. In this assay, only after sera are diluted considerably (e.g., 1:10,000) is 50% GFP transduction observed when compared to AAV9 control. However, for chimeric 2.5 and 2.5G9, 50% GFP transduction is observed with far less dilution (e.g., only 1:100 dilution) of this mouse serum. Animals pre-exposed to 2.5 and AAV2.5G9 A267 and then assayed for neutralizing activity against AAV1, 2, 2.5, 2.5G9 A267 and 9 yields expected results, with highest dilution required for the 2.5 and 2.5G9 vector (e.g., 1:8000) followed by lower dilution (e.g., 1:1000) for AAV2 and even lower dilution (e.g., 1:100) for AAV serotype 1 and AAV9 respectively.

The expected conclusions from these studies is that the amino acid alterations made in AAV2.5 to produce chimeric AAV2.5G9 A267, although small in number, are sufficient to significantly affect the immune profile for this virion when challenged with neutralizing antibodies specific for AAV2, AAV2.5, and AAV9.

These studies will indicate the AAV2.5G9 A267 vectors are suitable for transducing individuals pre-exposed to AAV1, AAV2, AAV2.5, AAV9, or combinations thereof, thereby providing greater versatility in available vectors. For example, this chimeric vector would allow for re-administration in animals and patients pre-exposed to AAV1, AAV2, AAV9 or AAV2.5. In addition, this demonstrates that selected amino acids can be changed in the AAV2.5 capsid amino acid sequence that significantly alter immune response.

Transduction of Brain and Liver is Also Preserved in the AAV2.5G9 Variant

Cell type and tissue tropism will also be confirmed by the following experiments. Six- to eight-week-old male C57bl/6 mice are utilized to determine efficiency of AAV2 and the 2.5 vector transduction in liver. The mice are anesthetized using 300 uL 2.5% Avertin, and $1 \times 10^{11}$ particles of AAV2, AAV2.5, AAV2.5G9 A267 and AAV9 vector carrying the human Factor IX (hFIX) transgene virus are dissolved in 250 uL PBS and injected slowly through the portal vein. The vectors are duplexed virus particles as described in international patent publication WO 01/92551. After 1 and 6 weeks, 100 uL of blood from each mouse is collected from the tail vein using heparin-coated capillary glass tubes. Serum is collected by centrifuging the blood sample at 4° C., 8000 rpm for 20 min. Sera are stored at −80° C. until tested. Expression of hFIX in the serum is tested by standard ELISA methods. Serial dilutions of normal human serum with hFIX levels of 5 ug/mL are used as a standard. Using this assay, it will be found that the 2.5 and the AAV2.5G9 vectors each have a reduced ability to transduce liver as compared with the AAV2 virus. This experiment will demonstrate that the AAV2.5G9 A267 variant exhibits the muscle tropism of the 2.5 vector, and also preserves the loss of the liver specific tropism the 2.5 vector in turn lost when compared to the liver specific tropism characteristic of AAV2.

In another experiment, the duplexed AAV2.5 vector, duplexed AAV2.5G9 A267 vector, duplexed AAV9 vector, and duplexed AAV2 vector, each containing a green fluorescent protein (GFP) reporter transgene cassette, are respectively injected into the cortex region of the mouse brain under conditions previously established for AAV2. The vectors are then assayed for neuron specific transduction. It is well-established that AAV1 and AAV2 are specific for neuronal transduction and that AAV2.5 vector transduces neurons as well as non-neuronal cells (glial cells such as astrocytes).

The sum of these experiments when testing the AAV2.5G9 A267 vector for tissue-specific transduction in vivo will likewise demonstrate that in addition to preserving the gained tissue-specific tropism (e.g., muscle, skeletal or cardiac) of AAV2.5 (previously reported as derived from the AAV serotype 1 parent), and preserving the lost cell type specific transduction (e.g., liver-hepatocyte-specific transduction) of the AAV2.5, the AAV2.5G9 A267 vector also preserves the new tropism (non-neuronal/astrocytes) of the AAV2.5 that is not present in either the donor parent (AAV1) or recipient parent capsid (AAV2) and is totally unique to the chimeric 2.5 vector.

Heparin Binding Experiments. Batch binding of rAAV to heparin agarose is performed as described previously (Rabinowitz (2004) *J. Virology* 78:4421-4432). Briefly, equivalent particles of rAAV virions are applied to heparin agarose type 1 (H-6508, Sigma, St. Louis, Mo.) in 1×PBS, allowed to bind for one hour at room temperature, centrifuged at low speed for 2 minutes, and supernatant (flow through) is then removed. Six washes of five bed-volumes of PBS 1 mM $MgCl_2$ are performed, followed by a three-step elution of five bed-volumes of PBS 1 mM MgCl containing 0.5 M NaCl (step 1), 1.0 M NaCl (step 2), or 1.5 M NaCl (step 3). The number of rAAV particles present in the washes and the 3-step elution is determined by dot blot hybridization.

Animal Imaging. $1 \times 10^{10}$ viral genome containing particles (vg) are injected into the gastrocnemius of 6-week-old male BALB/c mice. A total of 6 limbs are injected for each virus type using 25 ul of virus. Animals are imaged at different days post injection using the Roper Scientific Imaging (Princeton Instruments). Briefly, animals are anesthetized and injected IP with luciferin substrate. Ten minutes post-injection the animals are placed in the chamber and light emission is then determined. The average number of total pixels per region of interest is determined using the CMIR_Image software (Center for Molecular Imaging Research, Mass. General) and plotted over time.

Example 3: AAV2.5G9 Exhibits Dual Glycan Binding

AAV2.5G9 Exploits HS and Gal Receptors Interchangeably In Vitro Similar to AAV2G9

Competitive inhibition assays will provide evidence of the usage of dual glycan receptors by AAV2.5G9 variant by the following experiments. These assays utilize virus binding on the cell surface involving soluble heparin and ECL, which selectively binds terminally galactosylated glycans. A mutant CHO cell line, CHO-Lec2, is deficient in transporting CMP-sialic acids from Golgi compartments to the cell surface (Deutscher et al. *J. Biol. Chem.* 261:96-100 (1986)). Therefore, the majority of terminal glycan moieties on the CHO-Lec2 surface are galactose. This unique galactosylation pattern on the surface of CHO-Lec2 and sialylation of wild-type CHO-Pro5 cells can be useful in studying AAV-galactose/AAV-sialic acid interactions (Shen et al. *J. Virol.* 86:10408-10417 (2012); Shen et al. *J. Biol. Chem.* 286: 13532-13540 (2011)). HS, but not ECL, significantly inhibits AAV2 transduction in CHO-Lec2 cells, whereas ECL selectively blocks AAV9 transduction by nearly two log units. These results are consistent with the expected transduction profiles for AAV2 and AAV9 (Shen et al. *J. Biol. Chem.* 286:13532-13540 (2011); Summerford et al. *J. Virol.* 72:1438-1445 (1998); Bell et al. *J. Clin. Invest.* 121:2427-2435 (2011)). In contrast, AAV2G9 and AAV2.5G9 will only be effectively neutralized by pretreatment with a combination of both ECL and HS. A small but significant inhibitory effect may be observed for ECL.

The transduction profiles for AAV2, AAV2.5G9 A267, AAV9, and AAV2G9 are further corroborated by inhibition of cell surface binding of each strain using ECL or HS. The unique cell surface attachment of the chimeric AAV strain is further supported by competitive inhibition of cell surface attachment of AAV2.5G9 exclusively by a combination of ECL and HS but neither reagent alone. This is similar to AAV2G9 and will indicate the ability of AAV2.5G9 A267 to bind two different glycans interchangeably similar to AAV2G9.

In vitro characterization of the dual glycan-binding AAV2.5G9 chimera. Assays are performed for inhibition of AAV2, AAV2.5G9 A267, AAV2G9, and AAV9 transduction on CHO Lec2 cells with FITC-ECL and soluble heparin. CHO Lec2 cells are prechilled at 4° C. and incubated with FITC-ECL, soluble heparin, or both prior to infection with AAV2, AAV2.5G9 A267, AAV2G9, or AAV9 packaging a CBA-luciferase reporter transgene cassette. Transduction efficiency is measured 24 h post-infection as luciferase activity in relative light units. The percentage of transgene expression is calculated by normalizing transduction efficiency to relative light units from controls. Assays for inhibition of cell surface binding are performed with AAV2, AAV2.5G9 A267, AAV2G9, and AAV9 on CHO Lec2 cells with FITC-ECL and soluble heparin. Different AAV particles are bound to cells prechilled at 4° C., and unbound virions are removed by washing with cold PBS. Bound virions are quantified using qPCR after viral genome extraction. The percentage of bound virions is determined by normalizing number of bound virions to that of corresponding controls.

In Vitro Binding and Transduction Assays. CHO-Pro5 and CHO-Lec2 cells are cultured in α minimum Eagle's medium (Thermo Scientific) supplemented with 10% FBS, 100 units/ml of penicillin (Cellgro), 100 μg/ml of streptomycin (Cellgro), and 2.5 μg/ml of amphotericin B (Sigma). Cells are seeded at a density of $1 \times 10^5$ cells/well in 24-well plates.

Competitive inhibition assays. CHO-Lec2 cells are prechilled at 4° C. for 30 min and incubated with 100 μg/ml of FITC-labeled *Erythrina crista-galli* lectin (FITC-ECL, Vector Laboratories) in α minimum Eagle's medium at 4° C. for 1 h. Alternatively, different viral capsids are incubated with 100 μg/ml of soluble heparin (Sigma) or 1×PBS (control) at room temperature for 1 h. Mock-treated or FITC-ECL-treated cells are then infected with HS-bound or mock-treated AAV2, AAV2.5G9 A267, AAV2G9, or AAV9 capsids packaging a CBA-Luc transgene cassette at an MOI of 1000 vg copies/cell. Following incubation in the cold room for 1 hr, unbound virions are removed by three washes with ice-cold 1×PBS. For cell surface binding assays, the number of bound virions is measured by quantifying vector genome copy numbers/cell in each well using quantitative PCR. For transduction assays, infected Lec2 cells are moved to 37° C. and incubated for 24 h prior to quantitation of luciferase transgene expression from cell lysates.

Example 4: AAV2.5G9 Exhibits Unexpectedly Higher Transduction than AAVrh10

Human skin fibroblast GM16095 cells were transduced with either AAVrh10-luciferase reporter and AAV2.5G9-luciferase reporter. The multiplicity of infection (MOI) was 10,000. Transduction of GM16095 cells with AAV2.5G9 was substantially higher (118 fold) compared with AAVrh10 as measured by Relative Luciferase unit RLU Luc (data not shown). Similar experiments will be performed with various types of neuronal and glial cells to compare the transduction of the AAVrh10 with the AAV2.5G9. It is expected that the AAV2.5G9 will demonstrate significantly higher transduction in the neuronal and/or glial cells as compared to the AAVrh10.

The foregoing is illustrative of the present invention, and is not to be construed as limiting thereof.

TABLE 1

| AAV Genomes | |
|---|---|
| AAV Serotypes/Isolates | GenBank Accession Number |
| Clonal Isolates | |
| Avian AAV ATCC VR-865 | AY186198, AY629583, NC_004828 |
| Avian AAV strain DA-1 | NC_006263, AY629583 |
| Bovine AAV | NC_005889, AY388617 |
| AAV4 | NC_001829 |
| AAV5 | AY18065, AF085716 |
| Rh34 | AY243001 |
| Rh33 | AY243002 |
| Rh32 | AY243003 |
| AAV10 | AY631965 |
| AAV11 | AY631966 |
| AAV12 | DQ813647 |
| AAV13 | EU285562 |
| Clade A | |
| AAV1 | NC_002077, AF063497 |
| AAV6 | NC_001862 |
| Hu.48 | AY530611 |
| Hu 43 | AY530606 |
| Hu 44 | AY530607 |
| Hu 46 | AY530609 |
| Clade B | |
| Hu19 | AY530584 |
| Hu20 | AY530586 |
| Hu23 | AY530589 |
| Hu22 | AY530588 |
| Hu24 | AY530590 |
| Hu21 | AY530587 |
| Hu27 | AY530592 |
| Hu28 | AY530593 |
| Hu29 | AY530594 |
| Hu63 | AY530624 |
| Hu64 | AY530625 |
| Hu13 | AY530578 |
| Hu56 | AY530618 |
| Hu57 | AY530619 |
| Hu49 | AY530612 |
| Hu58 | AY530620 |
| Hu34 | AY530598 |
| Hu35 | AY530599 |
| AAV2 | NC_001401 |
| Hu45 | AY530608 |
| Hu47 | AY530610 |
| Hu51 | AY530613 |
| Hu52 | AY530614 |
| Hu T41 | AY695378 |
| Hu S17 | AY695376 |
| Hu T88 | AY695375 |
| Hu T71 | AY695374 |
| Hu T70 | AY695373 |

TABLE 1-continued

AAV Genomes

| AAV Serotypes/Isolates | GenBank Accession Number |
|---|---|
| Hu T40 | AY695372 |
| Hu T32 | AY695371 |
| Hu T17 | AY695370 |
| Hu LG15 | AY695377 |
| Clade C | |
| AAV3 | NC_001729 |
| AAV3B | NC_001863 |
| Hu9 | AY530629 |
| Hu10 | AY530576 |
| Hu11 | AY530577 |
| Hu53 | AY530615 |
| Hu55 | AY530617 |
| Hu54 | AY530616 |
| Hu7 | AY530628 |
| Hu18 | AY530583 |
| Hu15 | AY530580 |
| Hu16 | AY530581 |
| Hu25 | AY530591 |
| Hu60 | AY530622 |
| Ch5 | AY243021 |
| Hu3 | AY530595 |
| Hu1 | AY530575 |
| Hu4 | AY530602 |
| Hu2 | AY530585 |
| Hu61 | AY530623 |
| Clade D | |
| Rh62 | AY530573 |
| Rh48 | AY530561 |
| Rh54 | AY530567 |
| Rh55 | AY530568 |
| Cy2 | AY243020 |
| AAV7 | AF513851 |
| Rh35 | AY243000 |
| Rh37 | AY242998 |
| Rh36 | AY242999 |
| Cy6 | AY243016 |
| Cy4 | AY243018 |
| Cy3 | AY243019 |
| Cy5 | AY243017 |
| Rh13 | AY243013 |
| Clade E | |
| Rh38 | AY530558 |
| Hu66 | AY530626 |
| Hu42 | AY530605 |
| Hu67 | AY530627 |
| Hu40 | AY530603 |
| Hu41 | AY530604 |
| Hu37 | AY530600 |
| Rh40 | AY530559 |
| Rh2 | AY243007 |
| Bb1 | AY243023 |
| Bb2 | AY243022 |
| Rh10 | AY243015 |
| Hu17 | AY530582 |
| Hu6 | AY530621 |
| Rh25 | AY530557 |
| Pi2 | AY530554 |
| Pi1 | AY530553 |
| Pi3 | AY530555 |
| Rh57 | AY530569 |
| Rh50 | AY530563 |
| Rh49 | AY530562 |
| Hu39 | AY530601 |
| Rh58 | AY530570 |
| Rh61 | AY530572 |
| Rh52 | AY530565 |
| Rh53 | AY530566 |
| Rh51 | AY530564 |
| Rh64 | AY530574 |
| Rh43 | AY530560 |
| AAV8 | AF513852 |
| Rh8 | AY242997 |
| Rh1 | AY530556 |
| Clade F | |
| AAV9 (Hu14) | AY530579 |
| Hu31 | AY530596 |
| Hu32 | AY530597 |

TABLE 2

Exemplary AAV Genome and Capsid Accession Nos.

| Virus and Serotype | Genome Accession No. | Capsid/VP1 Accession No. |
|---|---|---|
| AAV1 | NC_002077.1 | NP_049542.1 |
| AAV2 | NC_001401.2 | YP_680426.1 |
| AAV3A | NC_001729.1 | NP_043941.1 |
| AAV3B | NC_001863.1 | NP_045760.1 |
| AAV4 | NC_001829.1 | NP_044927.1 |
| AAV5 | NC_006152.1 | YP_068409.1 |
| AAV6 | NC_001862.1 | NP_045758.1 |
| AAV7 | AF513851.1 | AAN03855.1 |
| AAV8 | AF513852.1 | AAN03857.1 |
| AAV9 | AY530579.1 | AAS99264.1 |
| AAV10 | AY631965.1* | AAT46337.1 |
| AAV11 | AY631966.1* | AAT46339.1 |
| AAV13 | EU285562.1 | ABZ10812.1 |

*Incomplete sequence

TABLE 3

Quantitative Assessment of Bioluminescence in the Central Nervous System.

| Group | Animal # | R. Frontal | L. Frontal | R. Parietal | L. Parietal | R. Temporal | L. Temporal | R. Occipital | L. Occipital | R. Cerebellum | L. Cerebellum | Spinal Cord |
|---|---|---|---|---|---|---|---|---|---|---|---|---|
| AAV9 | #1 | 26.8 | 16.3 | 92.2 | 35.0 | 86.5 | 81.4 | 63.1 | 18.0 | 86.9 | 14.9 | 4.2 |
|  | #2 | 4.0 | 5.6 | 7.5 | 6.5 | 24.2 | 283.7 | 22.8 | 174.8 | 2.0 | 12.3 | 10.4 |
| AAV2G9 | #3 | 65.4 | 45.2 | 223.7 | 226.9 | 250.0 | 489.8 | 232.5 | 555.0 | 0.0 | 0.0 | 20.3 |
|  | #4 | 0.0 | 0.0 | 498.6 | 576.7 | 2,240.0 | 4,760.0 | 5,262.0 | 3,240.0 | 153.6 | 187.8 | 2.6 |
| AAV2.5G9 | #5 | 20.2 | 240.0 | 44.5 | 418.8 | 180.3 | 404.0 | 82.7 | 1,985.0 | 1,067.0 | 1,098.0 | 5.1 |
|  | #6 | 0.0 | 0.0 | 31.9 | 16.8 | 131.6 | 9.4 | 238.4 | 0.0 | 33.4 | 45.3 | 1.2 |
|  | #7 | 158.0 | 63.6 | 413.0 | 188.5 | 1,934.0 | 205.3 | 808.4 | 203.7 | 98.5 | 81.7 | 46.6 |
|  | #8 | 101.2 | 52.7 | 349.3 | 305.8 | 1,852.0 | 259.9 | 2,675.0 | 257.8 | 185.7 | 7.6 | 5.2 |
|  | #9 | 180.3 | 836.9 | 850.1 | 936.3 | 1,129.0 | 646.0 | 793.1 | 181.9 | 2,978.0 | 268.9 | 50.3 |

TABLE 4

Evaluation of Vector Biodistribution in the Central Nervous System by Real-Time qPCR.

| Group | Animal # | R. Frontal | L. Frontal | R. Parietal | L. Parietal | R. Temporal | L. Temporal | R. Occipital |
|---|---|---|---|---|---|---|---|---|
| AAV 9 | #1 | 81.5 | 61.4 | 211.5 | 1,647.3 | 283.1 | 2,437.0 | 118.8 |
|  | #2 | 0.0 | 307.7 | 132.5 | 195.6 | 5,310.8 | 2,713.5 | 0.0 |
| AAV 2G9 | #3 | 109.0 | 223.2 | 225.7 | 834.7 | 2,198.7 | 1,174.1 | 207.3 |
|  | #4 | 0.0 | 202.2 | 10,444.0 | 571.5 | 2,222.3 | 2,933.2 | 30,256.2 |
| AAV 2.5G9 | #5 | 464.0 | 1,378.2 | 331.5 | 2,695.3 | 106.4 | 28,274.3 | 589.6 |
|  | #6 | 152.6 | 0.0 | 83.5 | 338.7 | 1,840.8 | 22.5 | 775.2 |
|  | #7 | 130.4 | 377.3 | 135.2 | 514.3 | 322.7 | 916.6 | 160.0 |
|  | #8 | 97.6 | 260.6 | 1,323.7 | 375.6 | 3,784.1 | 1,294.6 | 3,445.5 |
|  | #9 | 653.8 | 1,179.3 | 1,433.8 | 1,556.3 | 1,249.3 | 679.6 | 2,015.1 |

| Group | Animal # | L. Occipital | R. Cerebellum | L. Cerebellum | Cervical SC | Thoracic SC | Lumbar SC |
|---|---|---|---|---|---|---|---|
| AAV 9 | #1 | 271.4 | 150.7 | 487.7 | 1,562.4 | 651.3 | 809.4 |
|  | #2 | 1,024.4 | 705.7 | 6,147.8 | 440.7 | 898.5 | 1,292.0 |
| AAV 2G9 | #3 | 826.8 | 0.0 | 312.6 | 549.4 | 317.7 | 527.7 |
|  | #4 | 169.4 | 132.3 | 460.8 | 2,006.8 | 1,402.9 | 609.6 |
| AAV 2.5G9 | #5 | 3,490.1 | 79.5 | 36,558.6 | 779.7 | 9,167.3 | 9,272.1 |
|  | #6 | 0.0 | 236.0 | 3,527.6 | 669.3 | 578.8 | 252.4 |
|  | #7 | 757.2 | 309.2 | 178.5 | 126,384.3 | 7,228.8 | 6,107.2 |
|  | #8 | 1,414.1 | 5,518.0 | 24.5 | 5,422.7 | 2,692.5 | 1,548.3 |
|  | #9 | 772.2 | 647.3 | 59.6 | 11,304.7 | 0.0 | 89.5 |

SEQUENCE LISTING (448 sequences)

SEQ ID NO: 1 - DNA, 1011 bp, Mus musculus
atgatggttgagttcgctcctcttaacactcctcttgctagatgccttcaaactgctgctgttcttcaatgggttctctctttcttgctccttgttcaagtgtgcatcggaatcatggttatgctcgttctctacaactactggttcctctacatcccttacctcgtttggttctactacgattggagaactcctgagcaaggtggaagaagatggaactgggttcaatcttggcctgtttggaagtacttcaaagagtacttccctatctgcctcgttaagactcaggatcttgatcctggacacaactacatcttcggattccatcctcatggaatcttcgtgcctggtgctttcggaaacttctgtactaagtacagcgacttcaagaagcttttccctggattcacctcttacctccatgttgctaagatctggttctgcttcccactcttcagagaatacctcatgtctaacggacctgtgtctgtgtctaaagaatctctctctcacgttctctccaaggatggtggtggaaacgtttcaatcatcgttcttggaggtgctaaagaggctcttgaggctcatcctggaactttcactttgtgtatcagacagcgtaagggattcgttaagatggctcttactcacggtgcttctcttgttccagttttctcattcggagagaacgatctctacaagcagatcaacaaccctaagggatcttggcttagaactatccaggatgctatgtacgactctatgggagttgctttgcctcttatctacgctagaggaatcttccagcactacttcggaatcatgccttacagaaagctcatctacaccgttgttggtagacctatccctgttcaacagatccttaaccctacttctgagcagatcgaggaacttcatcagacttaccttgaggaactcaagaagttgttcaacgagcacaagggaaagtacggaatccctgagcatgagactctcgttttcaagtgatga

SEQ ID NO: 2 - DNA, 1008 bp, Mus musculus
atggtcgagttcgctccacttcttgttccttgggagagaagattgcagactttcgctgttcttcagtgggttttctcattccttgctcttgctcaactctgcatcgttatcttcgttggactcttgttcaccaggttctggcttttctctgttctttacgctacctggtggtacttggattgggataagcctagacaaggtggtagacctatccaattcttcagaagattggccatctggaagtacatgaaggattacttccctgtgtctctcgttaagactgctgagcttgatcctagccgtaactacattgctggattccatcctcatggtgttcttgctgctggtgctttccttaacctctgtactgagtctactggattcacctctttgttccctggaatcagatcctaccttatgatgcttaccgtttggttcagggctccattcttcagagattacatcatgtctggtggactcgtgtctagcgagaaagtttctgctgatcacatccttagcagaaagggtggtggaaaccttcttgctatcatcgttggaggtgctcaagaggctcttgatgctagacctggtgcttacagacttctcttgaagaaccgtaagggattcatcagacttgctcttatgcatggtgctgctcttgttcctatcttctcattcggagagaacaacctcttcaaccaggttgagaacactcctggaacttggcttagatggatccagaacagactccaaaagattatgggaatcagccttccacttttccatggaaggggagttttccaatactctttcggactcatgcctttcagacagcctatcactactatcgttggaaagcctatcgaggttcaaatgactcctcagccttctagagaggaagttgatagacttcaccagcgttacatcaaagagttgtgcaagcttttcgaggaacacaagctcaagttcaacgttccagaggatcagcatcttgagttctgctaatga

SEQ ID NO: 3 - DNA, 1008 bp, Ciona intestinalis
atgtgggagttcgcccctcttagaatccctatgatcagaagattgcagacccttgctgtttctcacttcgtgttctgtttcttggctcttgctgctacttgcactcttcttactatctatatcaccctcttcaccagctactggcctatcactactgcttacctcgttttcttgttcctcgatcgtaacactcctgagtctggtggtagaagatctgagtgggttagaaactggtctttgtggaagtggatgtctgattacttcccttgtacccttcacaagaccgttgatcttgatcctaagaggaactacatcttcggaatccatcctcatggtgttctctgtatcggatctttcactcacttctctaccaacggatctggattctctcatgttttccctggattcacctcctaccttactatgcttccattctggttcaagatgcctttcttcagggattacgtgatgtctggtggacttactcctgctactaggaaggctatcaagcacactatcactagacctggtggtggacatatctgttgtattatccctggtggtgctcctgagtctcttaacgctagaccaggtgatgttgttcttttgcttaagcagagactcggattccttaagcttgctatcactaacggtgttcctcttgttcctgtgttctctttcggtgatcatgctctttgggagcaaaagcctaaccctcctggatctcttatcagaagattccaggactctagccaaaagtggatgcaagttgctctccctgttttccatgctagaggaatcttccagtacaacttcggactcatcccttacagaagatctgttcacactgttgttggagagcctatcgaagttcctcaaaactctaaccctacctctgaggatctcatgtctcttcaagaggactacatcaacagactcagggctatcttcgatgagcacaagtctaagtacctccctgaggattgcaagctcatcatcaactgatga

SEQ ID NO: 4 - DNA, 1020 bp, Tribolium castaneum
atgaagatcctcggaatcaagttcgctcctcttcatatccctcttgagagaagattgcagactcttgctgctggatgttggttcactactcttgctttcggaactttcatcggaaccttcatctgggtttacgtgttcttcaccaggttctggtacttgtctgttctttacgccaccatcatctacctcgagaagtctaagtgtgagaagggtggtagacctatcgagtggatcagacattggggatggtggtactacctcaagaactacttcccttgcaagctcgatttcgttcctggacttactttcgatcctaagaggaactacctcttcgcttgttaccctcatggaatcctccctgctggacctttcaacactatcggatctccatactctgagttcagcaagcttttcccaaagttcagagtgagactcgttatccttcaccagcatttcttcatcccattccttagagagatcgcttacggaactggtggaatctctgcttctgctaagtctcttaaccacgttctcggatctccagagggaggttacattgctgttcttatgcctggtggtgctgttgaggcttacaactctagacctggacagtacagaatcatcctcaagaacagaaagggattcgttaagctcgctctcagaaacggatctcctcttgttcctgttatctctttcggagagcctgagcttttcgatcaagttgagggaagaaccctcagaaagatccaagagtctatcagaaagtaccttggactcgctcctgttatcttctctggaagaggattcttccagtactctttcggagttatccctcaaagaaggcctatcactactgttgttggacaccctatcgaggttacaaagatcgagaagcctaccaacgaggaagttgacgagcttcacaaaaagtacatgcaagagcttgagaacttgttcgaagagtacaagttcaagtacctcgagaaccctaaggatatccatcttgagttcgagtgatga

SEQ ID NO: 5 - DNA, 867 bp, Danio rerio
atgctcggagccctttacgctggatggctttaccttgatagagatacaccttcttgcggaggtagaagatctcaatgggttagatcttggaggatctggatgcacttcagagattacttccctatcaccctcgttaagaccgttgatcttgatcctaggcacaactaccttctcggattccatcctcatggtgttcttgttgctggtggattcggaaacttctgtactgaggcttctggattctctcaaatgttccctggacttaccccttaccttcttatgcttccattctggttcagggtgccattcttccgtgagtacatcatgtgcggaggacttgtttcttctgagaaggcttctgcttcttaccttcttggacatcctggtggtggacaagctgctgttatcgctgttggaggtgctcctgagtctcttgaggctagacctggtgctcttactcttcaacttcttcagaggaagggattcatcaagcttgctcttaagcacggtgcttggcttgttccagttttctcattcggagagaacgagcttttcgaccaaatggaaaaccctgctggatctgctctcagaagaatgcaagaaagactccagaggattatgggagttgctctcccacttttccatgctaggggagttttccaatactctttcggacttctcccatacagaaagcctatccataccgttgttggtagacctatccctgtttctcaaactccttgcccttctaaagaggatatcgacgctctccacactctctacatgcaaggacttacccaggtgttcgaggaaaacaagaagcactacggaatcgctgatgataagcaccttaagttcacctgatga

SEQ ID NO: 6 - DNA, 762 bp, Danio rerio
atgagggactacttccctatcagacttatcaagaccgctgatctcgacaccagaaagaactacgttatgggattccatcctcacggaatccttgttgctggtgcttttactaacttctgcactgaggctaccggattctctaagttgttccctggaatcaagagcaaccttcttatgcttcctctttggttccgtgctccattcttcagagactacatcatgtctgctggactcgttccttctgacaaagagtctgcttcttacctccttagaagaaagggtggtggaaacgctgttgttatcgctgttggaggtgctcctgaggctcttgatgctcatcctggtgattacactgttcaccttgctaacaagaagggattcatcaagcttgctatcgagcatggtgctgatcttgttcctatctactctttcggagagaacgaggttttcgatcaagttcaaaaccctagaggaacctggcttcgttacatccaagaaagactccagaggattatgggagtttctcttccacttttccacgctaggggagttttccagtacactttcggacttatgccttaccgtaagcctatcaacaccgttgttggtagacctatccctgttgagaagaacgagaagcctactgctgaggaacttgatgtttaccatcagcgttacatggatgagcttgctagacttttcgaggatcacaagggaaactacggtgttcctgaggatactcatctcgttttccagtgatga

SEQ ID NO: 7 - DNA, 1093 bp, Homo sapiens
cgtgggtgcaggctgcagtggctggcgccgtcctcgcccggccaggccatgaaggtagagtttgcaccgctcaacatccagctggcgcggcggctgcagacggtggccgtgctgcagtgggtcctttcttttcttacagggccgatgtccattggaatcactgtgatgctgatcatacacaactatttgttcctttacatcccttatttgatgtggctttactttgactggcataccccagagcgaggaggcaggagatccagctggatcaaaaattggactctttggaaacactttaaggactattttccaattcatcttatcaaaactcaagatttggatccaagtcacaactatatatttgggtttcacccccatggaataatggcagttggagcctttgggaatttttctgtaaattattctgacttcaaggacctgtttcctggctttacttcatatcttcacgtgctgccactttggttctggtgtcctgtctttcgagaatatgtgatgagtgttgggctggtttcagtttccaagaaaagtgtgtcctacatggtaagcaaggagggaggtggaaacatctctgtcattgtccttgggggtgcaaaagaatcactggatgctcatcctggaaagttcactctgttcatccgccagcggaaaggatttgttaaaattgctttgacccatggcgcctctctggtcccagtggtttcttttggtgaaaatgaactgtttaaacaaactgacaaccctgaaggatcatggattagaactgttcagaataaactgcagaagatcatggggtttgctttgcccctgtttcatgccaggggagtttttcagtacaattttggcctaatgacctataggaaagccatccacactgttgttggccgcccgatccctgttcgtcagactctgaacccgacccaggagcagattgaggagttacatcagacctatatggaggaacttaggaaattgtttgaggaacacaaaggaaagtatggcattccagagcacgagactcttgttttaaaatgacttgactataaaaaaaaattaaaaaataaaaataaatgac

SEQ ID NO: 8 - DNA, 1008 bp, Mus musculus
atgatggtcgagttcgcgccactcaacaccccgctggcacggtgcctacagaccgctgcggtgctgcagtgggtcctgtccttcctcctgctcgtgcaggtgtgcattggaattatggtgatgctggtcctgtacaactattggttcctttacatcccatatctggtctggttttactatgactggagaaccccagagcaaggaggcagaagatggaactgggtccaaagctggcctgtgtggaagtattttaaggagtattttccaatctgtcttgtcaaaacgcaggatttggatccgggtcacaattatatatttgggtttcaccctcatggaatattcgtgcctggagcctttggaaatttttgtacaaaatactcggacttcaagaagctatttcctggctttacatcgtatctccacgtggccaagatctggttctgtttcccgttgttccgagaatatctgatgagtaacgggccggtttcagtgtctaaggagagtttgtctcatgtgctgagcaaggatggaggtggcaatgtctcaatcattgtcctcggaggtgcaaaggaggcgctggaggctcacccaggaacattcaccctgtgcatccgccagcgcaaagggtttgttaagatggccttgacccatggtgccagtttggttccagtattttcttttggtgaaaatgatctatataagcaaattaacaaccccaaaggctcctggctacgaactatacaagacgcaatgtatgattcaatgggagtagccttgccactgatatatgccagaggaattttccagcactactttggcataatgccctatcggaagctgatctacactgttgttggccgccctatccctgttcagcagattctgaacccgacctcagagcagattgaagagctgcatcagacatacctagaggagctaaagaaactattcaatgaacacaaagggaaatatgggattccggagcacgaaactctggtatttaaataa

SEQ ID NO: 9 - DNA, 1093 bp, Pan troglodytes
cgtgggtgcaggctgcagtggctggcgccgtcctcgcccggccaggccatgaaggtagagtttgcaccgctcaacatccagccggcgcggcggctgcagacggtggccgtgctgcagtgggtcctttcttttcttacagggccgatgtccattggaatcactgtgatgctgatcatacacagctattcgttcctttacatcccttatttgatgtggctttactttgactggcataccccagagcgaggaggcaggagatccagctggatcaaaaattggactctttggaaacactttaaggactattttccaattcatctcatcaaaactcaagatttggatccaagtcacaactatatatttgggtttcacccccatggaataatggcagttggagcctttgggaatttttctgtaaattattctgacttcaaggacctgtttcctggctttacttcatatcttcacgtgctgccactttggttctggtgtcctgtctttcgagaatatgtgctgagtgttggcctggtttcagtttccaagaaaagtgtgtcctacatggtaagcaaggagggaggtggaaacatctctgtcattgtccttgggggtgcaaaagaatcactggatgctcatcctggaaagttcactctgttcatccaccagcggaaaggatttgttaaaactgctttgacccatggcgcctctctggtcccagtggtttcttttggtgaaaatgaactgtttaaacaaactgacaaccctgaaggatcatggattagaactgttcagaataaactacagaagatcatggggtttgctttgcccctgtttcatgccaggggagtttttcagtacaattttggcctaatgccctataggaaagccatccacactgttgttggccgcccgatccctgttcgtcagactctgaacccgacccaggagcagattgaggagttacatcagacctatatggaggaacttaggaaattgtttgaggagcacaaaggaaagtatggcattccagagcacgagactcttgttttaaaatgacttgactataaaaaaaaatttttaaataaaaataaatgac

SEQ ID NO: 10 - DNA, 1008 bp, Pan troglodytes
atgaaggtagagtttgcaccgctcaacatccagccggcgcggcggctgcagacggtggccgtgctgcagtgggtcctgaaatacctgctgctcgggccgatgtccattggaatcactgtgatgctgatcatacacagctattcgttcctttacatcccttatttgatgtggctttactttgactggcataccccagagcgaggaggcaggagatccagctggatcaaaaattggactctttggaaacactttaaggactattttccaattcatctcatcaaaactcaagatttggatccaagtcacaactatatatttgggtttcacccccatggaataatggcagttggagcctttgggaatttttctgtaaattattctgacttcaaggacctgtttcctggctttacttcatatcttcacgtgctgccactttggttctggtgtcctgtctttcgagaatatgtgctgagtgttggcctggtttcagtttccaagaaaagtgtgtcctacatggtaagcaaggagggaggtggaaacatctctgtcattgtccttgggggtgcaaaagaatcactggatgctcatcctggaaagttcactctgttcatccaccagcggaaaggatttgttaaaactgctttgacccatggcgcctctctggtcccagtggtttcttttggtgaaaatgaactgtttaaacaaactgacaaccctgaaggatcatggattagaactgttcagaataaactacagaagatcatggggtttgctttgcccctgtttcatgccaggggagtttttcagtacaattttggcctaatgccctataggaaagccatccacactgttgttggccgcccgatccctgttcgtcagactctgaacccgacccaggagcagattgaggagttacatcagacctatatggaggaacttaggaaattgtttgaggagcacaaaggaaagtatggcattccagagcacgagactcttgttttaaaatga

SEQ ID NO: 11 - DNA, 1008 bp, Canis familiaris
atgaaggtcgagtttgcgccgctccacatcccgctggcgcggcggctgcagacggccgcggtgctgcagtgggtcctgtccttcctgctgctcgcgcaggtgtgcatcggaatcatcgtggtactgatcgtgcacaactattggttcctctacgtcccttatctgacatggctttgccttgactggcggaccccagagcagggaggcaggagatccaactgggtcagaagctggaccgtttggaggtattttaaggactattttccaattcacctcatcaaaacttgggatttggatccaagtcacaactatatatttgggtttcacccccacggagtgcttgttgctggagcctttggaaatttttgtacgaatcattcagacttcgaggagctgtttcctggcttcactgcgtatcttcacgtgctcccattttggttccggtgtcctctctttcgagaatatctgatgactagcgggtcagtctcagtttctaagaaaagtgtgtcctatgtgctgagcaaggagggaggtggaaacatttcagtcattgttcttgggggtgcagaagaatcactggatgcccatcctggaaaattcactctgttcatccgccagcggaaaggatttgttaaagtggctttgacccatggtgcctccttggtcccggtgttttcttttggagaaaatgaactatttaagcaagttaacaaccctgaaggctcatggcttcgaactgtgcaggagaagctacagaagatcatgggatttgctttgcctctgttccatgccagagggatttttcaatacaattttggcctgatgccctataggaaacctatccacactgtggttggtcgcccaatccctgttcatcggactccgcacccaagcccgggacagattgaggagttgcatcagacctatatggaggagctaaggaaattatttgaagcacacaaaaggaagtacggtattcccgagcatgaaactctcatttttaaataa

SEQ ID NO: 12 - DNA, 1118 bp, Bos taurus
atgaaggtcgagtttgcgccactcaacatcccgctggcgcggcggctgcagacggctgcggtgctgcattggttgctgtccttcctgctgttcgcacaggtatgcctcggaattatcgtgttcctgatcatatacaactactggttcctctaccttccttacttgacatggctttactttgactggcaaaccccagagcaaggaggcagaagatctgaatgggtcagaaactgggccatttggaggtactttaaggactattttccaattcatctcatcaaaacctgggatttggatccgagtcacaactacatatttgggtttcacccccatggagtgcttgtggttggagcctttggaaacttctgtacaaattattcggccttcaaggagctgtttcccggctttacctcctatcttcacgtgctgccgtattggttccggtgtccgctcttccgggaatatctgatgagcagtgggccagtctcagtttccaagaaaagtgtgtgccacgtgttaagcaaagagggaggtggaaacatctcagtcattgtgctcgggggtgcagaggaatcactggatgcccatcctggaaagttcactctgttcatccgccagcggaagggattcgtgaaaattgctttgacccatggtgcttatttggtgccagtgttttcttttggtgaaaatgaactatttaaacaagttagcaatcccgaaggatcatggcttcgaaatgtgcaggagaaactacagaagatcatgggatttgctttgccactgttccacgccagaggaatttttcaatacaattttggcctaatcccctataggaagcccattcacactgttgttggccgcccaatccctgttcgtcagaccctgaacccaacctcagagcagattgaggagttgcatcagacctacatggaggagctgagaaaattatttgaagaacacaaagggaagtatggtattccagaaaatgaaactctcatttttagataactgttgtcttagaagtcatgcaagagagcgagagaacatcccactgaaagaaaagatattctaaataaatttttttctttgacaatggaatcaaatttgcaactgtaaaa

SEQ ID NO: 13 - DNA, 749 bp, Rattus norvegicus
ttgactcactaagggccagtttcagtttctaagaggagtttgtctcatgtgatgagcaaggaaggaggtgggaacatctcagtcattgtcatcgggggtgcgaaagagctactggagtccttccctggaagatattctctgtgccttcttcagcgcaaaggatttgttaagatcgccttgacccatggtgcccatttggttccagtgttttcttttggtgaaaatgaactatatagccaagtcgacaaccctaaaggctcatggcttcggactgcccaagacaaagtgtataacctaacggggttggccttgccactattctatgccagaggaattttccagaacagctttggcctaatgccctatcggaaattgatctacactgttgctgcggttggcacagcagctcgtttgactcagaagtcaaaccatcagaacgacagctcagtgtctgctgagaagggaaactcttttatttgttgtcaagtgggatggtgtgaccgagataggcagccattggccgccccatccctgttcagaagactctgcacccgaccccagagcagattgatgagctgcatcagacgtacatggaggagctaaggaaactcttcaatgaacataaagggaaatacggtattccggagcatgaaactctggtttttaaataaccgtcttcctccaagccatactgaaggaagacaagaaaacattgttgagaaaataaatattttaaataacttctctgt

SEQ ID NO: 14 - DNA, 1547 bp, Danio rerio
ttttttttttttttttcctgtttgagctgtctttattatcgtcctcgccattgagttcgctcctctgcgcgtgcctctgcgcaggcgcattcagacggccgcggtggtccagtgggtcttcagcttcttggctctggctcaggtgtgtctggccgcgttcgtgctgctgtgtctcagtgattggtggatgctcggagcgctgtatgctggttggctgtatctggaccgggacacgccctcatgtggaggtcggaggtcacagtgggtcagaagctggaggatctggatgcatttcagggattatttcccaatcacactggtcaagacggtggatctggacccgaggcacaattacctgctgggtttccatccgcacggtgttctggtggccggtggattcgggaacttctgcacggaggcgtccggattctcccagatgttcccgggactcacgccgtacctgctgatgctgccgttctggttcagggtgcccttcttcagagaatacatcatgtgcggagggctggtgtccagtgagaaggccagtgcgagttacctgctgggtcatccaggcgggggtcaagcggccgtcattgcagtgggcggagctccggagtctctggaggcgcggcctggagcactgacactgcaactgctgcagcgcaaaggcttcatcaaactcgccctcaaacacggagcgtggctggttccagtgttctcgtttggggagaacgagctcttcgaccagatggagaatcccgcaggctccgccctccgccgcatgcaggaacgcctccagaggataatgggcgtggctttgcctctctttcatgctagaggagttttccagtacagcttcgggctgctgccgtacaggaaacccatacacaccgtcgttggacgtcccattcctgtaagtcagactccgtgtcccagtaaagaagacatcgacgctcttcacacactctacatgcagggcctgacacaggtgtttgaggagaacaagaaacattacggcatcgcggacgacaaacatctgaagttcacctgaactgatctgtgtgtgtgtgtgcgcgtgcgtatgtgtttgtttgtgtgtgtgtgtgtgtgtgtgtgtgtgcgttgcatataatctagaatgattatctaccatctagttaaaggtcttggtacgaggggttgtgtagttgtgttgtcatgtgatatgacgatattcagaataacccacagcttgagctgaagtacggttactacacagtgtataaaacattaaggagatccttttactgttatcctccttcactacagtatggtaaatattgttactgtattttatgacttcattaaaacactatgtgaccgccattaagattattaaatgttcagattaaacaggtcatgaacactctgggttttacagatcttcaggattccctcctgtgcttaaatcagatttgttcttaatcagcaaatgtgtgttgatgtgtatgacaacagaaacacaaataaagcggtgctgtttattattttaaaaaaaaaaaaaaaaa

SEQ ID NO: 15 - DNA, 1279 bp, Caenorhabditis elegans
attcttcattggacctctacgaccaccacacagtcagtcatgttagatcgaacagaaagtgaagataagatgccacatctactaggagttgagtgggctccgctcaatattccgttggctcggcgtcttcaaactttgggagcacttcatttcttcttcatcactctcttcacaccagtactcgttctcaccgttccattctacatgttatataccgtactctggcctttgatctttctgtatgggctttggatgatttacgattggaattcaccaaagaagggagcctatatgagcaattggttccagagacaaagaattcattcgtggtatgccaactattttccagtcaaattgcacacaacatctgacatgccagaagaacataactatttgattgggtaccatccgcatggaataatttcaatggccgcattcatcaactttgcaacaaatggaactggaattctcgatactcttccacgaattcgtttccatttgtgcacacttgttggtcaattctggactccgtggagacgtgagtggggattgttgcacggaatgatagactgcagtcgagaaagcatcaagcacgttttggagcatgaaaagaaaggaaaagcagttgtattggtggttggtggagctgaagaagcacttgatgcacatccaggatgccatattttgactttgaaaaaaaggaaaggattcgtgaaaattgccctgcaaactggagctcaactggttccatgctattcattcggtgaaaatgatattttcaatcaagccgaaaatccaaagggatcaacaattcgacagttccaaacgataatgaaaagagtcttgggattctcccctccagcattctatgggagaggagtattcaactatacatttggtcttcttccattcagaaaacctatcaacactgttctcggcgctccaatttcagtgacaaagacagtgaatccaactcaagaacaaatcgacacacttcatcagacatacatggaccgtcttcatgagcttttcgaggagcacaagacaaaatacgatgtctctccaactacacaacttgttatcaattaaatattatctatttaatcacgtttgatgcacttttctcatatttacatctctattatacctcattctgcaatttagttcatattttcagccaatttttcaatattacgagttctcatgtcaaatatccccatcagattcagttactagttcagttatttttaatcgatctctattataagtttcgacacag

SEQ ID NO: 16 - DNA, 1089 bp, Caenorhabditis elegans
attcttcattggacctctacgaccaccacacagtcagtcatgttagatcgaacagaaagtgaagataagatgccacatctactaggagttgagtgggctccgctcaatattccgttggctcggcgtcttcaaactttgggagcacttcatttcttcttcatcactctcttcacaccagtactcgttctcaccgttccattctacatgttatataccgtactctggcctttgatctttctgtatgggctttggatgatttacgattggaattcaccaaagaagggagcctatatgagcaattggttccagagacaaagaattcattcgtggtatgccaactattttccagtcaaattgcacacaacatctgacatgccagaagaacataactatttgattgggtaccatccgcatggaataatttcaatggccgcattcatcaactttgcaacaaatggaactggaattctcgatactcttccacgaattcgtttccatttgtgcacacttgttggtcaattctggactccgtggagacgtgagtggggattgttgcacggaatgatagactgcagtcgagaaagcatcaagcacgttttggagcatgaaaagaaaggaaaagcagttgtattggtggttggtggagctgaagaagcacttgatgcacatccaggatgccatattttgactttgaaaaaaaggaaaggattcgtgaaaattgccctgcaaactggagctcaactggttccatgctattcattcggtgaaaatgatattttcaatcaagccgaaaatccaaagggatcaacaattcgacagttccaaacgataatgaaaagagtcttgggattctcccctccagcattctatgggagaggagtattcaactatacatttggtcttcttccattcagaaaacctatcaacactgttctcggcgctccaatttcagtgacaaagacagtgaatccaactcaagaacaaatcgacacacttcatcagacatacatggaccgtcttcatgagcttttcgaggagcacaagacaaaatacgatgtctctccaactacacaacttgttatcaattaa

SEQ ID NO: 17 - DNA, 1149 bp, Caenorhabditis elegans
tcagctttccactgaaaatgccgcaatttctcggaatagaatgggtggatctattctcatcaattcaacgtaaaaagacatacttgggagttgtctatcactttatgctcacttacccacttgcacttttcgtcaccattttgccatttttcttgcttttcactttccaatggcacattttggctctctacgcttgctggtacttctacgatatggattctccgaggagaggtggatattccagtgattgggtcagaaaatggcgtgtcaacgactggttcgcccaatacttcccaatcaacttgcacaaaactgccgaactctccacggacaagaactatctggttggaatccatcctcatggtatcatctccatggctgcatggtctaattttgccaccaatggaacgggaatctatgagaaattccctggaattcgctggaatttgtgcactttagcacttcagttcagaatggccatccgtcgtgagcttctccttctcaccggcctaatcgactgctccagagaatccattgaatatgtgcttgacaaatgtggccagaagggacgtgcagtggtattggtgattggaggagccgaagaagctttagatgctcatccaggctaccacacactcactttggcatcaagaaagggatttgttcgggaggctttgattactggtgcctacttggtcccggtgtattcttttggagagaatgacgtttttgaacagatggagaatccagttggctcacggctccgcaacttccaagaatggtgcaaaagcattttcggcatctcatatccaattttccatggtcgtggcttcttccaactaactttcggatatcttccattccgtaaaccaatcgataccgtagtcggagccccaattcccgttgaaaaagtggaaaatccgacgaaagagcaaatcgacgagcttcacaccatttattgtcaaaagttgacggagctgttcgatgagcacaaggaaaaatatggagtggagaaggacgtgccgttggtgctccggtagagcggaaaatttgaaatgttctgtgaaaagtgccagtttttgatgagatttctgtattttatcgtgccataatttttgtttttcgagccttgttttaagttgttacggt

SEQ ID NO: 18 - DNA, 1136 bp, Caenorhabditis elegans
atgctaaactaccaaattcacaaaaagctcaccgacatcaagtgggtgaacatcttctccccatgggatcgccagcgtgcctacttcgccttggtcgtctggttcgggctcatctacccattctgctgcctgtgccaggtggctccgtttgtgctctttttcaccggccagtggattattttgggtctctacgcagtttggtacctttacgatcgagaatctccgagaagaggaggatatcgggataattggttcagaaatttgtcgctgcacaagtggttcgccgagtattttcctgttaaacttcacaaaactgcggagttggatccaaaccaaaattatttattcggatatcatcctcatggaattctcggtgtcggagcgtggtcttgttttggatttgatgcgtgcaatgtgaagcaagtgttcaaaggcatccgcttcaacatctgcaccttgcccggcaacttcaccgcaatgttccgccgcgagatcctcctcagcatcggtatgatcgagagctccaaagaatccatcgagcacgtgctcaactccgaggaaaagggccgtgccgttgtaattgtcgtgggtggagccgctgaagctcttgaagctcacccagggaagcatactctaacactggcaaatcgcaaaggtttcgtgagagaagccgtgaagaccggagctcatctggtgccagtttatgcgtttggagagaatgacatatataagcaaattgacaacccggaaggctcgaaattacggaaaattcaagaatggggaaagaagaaaatgggaatttcactgccactaatctacggaagaggatattttcaaatggctcttgggcttcttccaatgagccgagctgtgaatgtagttgtcggagcgcctattcaagtggaaaaagagctcgatccttctaaggaagtcattgatgaaattcatggagtttatatggaaaagctcgccgagttatttgaagagcacaaggcaaagttcggagtttccaaggacactcggctcgtttttcagtgaaataacttttattttagattatttgtttgatgtttgatgtctgttatgttatcattttttatcaccaaatcgtgtaattttgtttacgggttcattac

SEQ ID NO: 19 - DNA, 1176 bp, Caenorhabditis elegans
atgagactccggctgagctcgatatctggaaaggcgaagcttcccgataaagaaatatgctcatcagtttcgagaatattggcaccattgcttgttccatggaagcgacgactcgagactcttgccgtgatgggtttcattttcatgtgggtaatcctaccaatcatggacctctgggttccattccacgtcttgttcaatactcgatggtggttccttgttccactctacgctgtctggttctactatgattttgatacaccgaaaaaagcttcaagaagatggaattgggccagaagacacgtagcctggaagtactttgccagctacttcccattgagattgatcaagactgctgaccttccggcggatcgtaattacatcattggctctcatcctcatggaatgttctcggttggtggttttactgcaatgagcaccaacgcgaccggatttgaagacaagttcccgggaataaaatctcacatcatgacgctaaatgggcaattttatttcccatttcgtcgagaattcggaataatgctcggtggaatcgaagtttcgaaagaatcacttgaatacactctaactaaatgtggaaaaggacgagcatgcgcaattgtcattggcggagcctcggaggctcttgaagctcatcccaataaaaatacattgacgttgatcaatcgacgtggtttctgcaaatatgctctgaagtttggagcagacctcgtaccaatgtacaatttcggagagaatgatttatacgagcagtatgaaaacccgaagggatctagattgcgagaagttcaggagaaaatcaaggacatgttcggattgtgtcccccattgctccgcggtcgatcgttgttcaaccaataccttatcggattgctgccgttccgaaaaccagttacaacagtcatgggaaggccaattcgagtcacccaaaccgacgagccaaccgttgagcagattgatgagctgcatgcaaaatattgtgatgctctctacaatctgttcgaggagtacaagcatcttcactccattcctcccgacactcatctcatcttccagtgactttttcacaaattttgtatattttgcacacagattgttttatcgccaagttaatgtatagtaatcttcttgtaaataaatcagataaacattaaa

SEQ ID NO: 20 - DNA, 1239 bp, Kluyveromyces lactis
atgggtaaggaacaaatcagaaagagacaaactaaaaaggtacgcaagggttcacaacccgtggcaaatggtaaatcttctgtagtaggggtctccaaagatgggaaaccagaattttgtgctattgatacgcccatagaaaggagacttcaaactctcagcgtagcatggtatgtcgaatgtattccgttaatgatcatcataatgttgtttgtttgggttaacccgttgatgtggtcgtttgtaataccatacaccatttattatttcatagaccggactgcctccaatgggaacgctgtgaagagacactccaagtggttccgatctctaaaggtctggttttatttccgtgattacttccctataagtatgcacaaaagcactgaactcgagccaacatttacaagtattgattccacagagctggaaaatgatgcgagtgagccaggctacctggatagctcacagcccgttttaccagataaatggtggaatcctttcagagaaaaggatgaaactgttagaccaacaggaccgaggtatatttttggctaccatccacatggtatagcagcattcggagcgtttggagcattcgctaccgaggcatgtaattggagtaaagttttcccaggcattccagtgtgtttgcttactttggtaaatcaatttcaaataccagtgtaccgtgattatttattggccttaggcataacatcggtcgctagaaaaaatgctatgaaagtacttgagaaaaattattcaatagccatcgtaattggaggtgccagtgaatcccttcttactaaccttggttcatctgatatcattttaagcaagcggaaaggttttgtgaagttggctttgcaaactgggaatgtgagtcttgtacctgtgtatggatttggtgaaactgatacttacaagattctgaagcttaaaaatgactctataataggcaggatacagatatggcttaaagagaactacagcttcactgtccctctatttttcgctcgtggtgtattcaattatgattttggtttactaccgtttagacatccagtcaatgttgttgttggaaaccctattcatattaaagaaaagatagatcatccaacaattgaggagattgatcattaccattccttatacattgaagaattgaaacgtctttacgatgataacaaggcaaaatttaactattcagaaaaaactttaaatatagtggaatga

SEQ ID NO: 21 - DNA, 1386 bp, Ashbya gossypii
atgcaggacagcatggatgacagcttgagggaggctgagggcagacaggacgactcggaggtcagcagcgggacgacactcggaagcagcaccccggaggacagcggggtgacggcgaagctgcgcaagaagtaccagatggcgtcggcactgctgcggcgggagctggaggagctgagcgtgtacgacgcgaagacggcgggggtaagcggccgcagcagcggcagcggcagcggcgggctggcgctgctgggcgggcgattccacgtggcgccgctgcggatccccgcgcggcggcggctgcagacgctggtggtggcgtggcacacgagctcgttcatctacatgacggtgctggtgctgtttctggcggcgaacccgctgatgtggtggttcatggtgccgtatatggtgtactacgtgtggaaccggtcgccggcgaacggcggagtggtgcggcggtactcgccgcggctgcggtcgctggcgctgtggcggtactactgcgagtactacccgatctcactgcacaagagcgaggacctggcgccgacgttcgtgccggacccgcggggggcggagccgcgcgagtggaagctgcggctgtggctgtggccgacgcgcgtggagctgctgaacttgacgctccagtggacgcgcgcgcggccgcaggttgcgacagggccgcgctacatcttcgggtaccacccgcacggcgtgggcgcactgggcgccttcggcgcgatcgcgaccgagggctgcaactggagcaaggtcttcgcgggcatcccggcctgcctgtgcacgctggtgaaccagttccagatccccatctaccgcgactacctgctgggcctcgggtgcacctccgtggcccgcaagaacgtgctcaaggtgctcgagcagaactactcggtctgcatcgtcgtgggcggcgcccaggaagccctgctcagccgtgtgggctccaccgagctcgtgctgaacaagcgcaagggcttcatcaagctcgcgctggagacgggcaacgtcaacctggtgcctatctacgccttcggcgagacagactgcttcaacgtgctcgacacgggcaacgagagctacctacgcaagttccagctgtggatcaagaagacctacggcttcaccatcccgttcttttttgcgcgcggtgtcttcaactatgacttcggcttcctgcccttcaggaatccgatcaacgtcgtcgtgggcaagcctgtgtacgtagacaagcgcagaacgaaccccaccatggaggaaatcgaccactaccacgacctgtacgtgcaggagctgcgcaatgtgttcgacaagaacaaacacaagttcggctacgccgggaaggaacttaaaatagtagagtag

SEQ ID NO: 22 - DNA, 1653 bp, Magnaporthe oryzae
atggccacggtagatgatacccagaaccatgtccaactgaatgcagagtccagcctaaacgaatttccgtaccaagcaagcgcggacaaggaggagtatccaagccttccttctgccccgctccctgacgtggacggcagctcccaaaatgggcatacagccgccaacgctgaccttccgccctcggagtcgaccgaacagccatggaacaaggtagccagtggcgacttcatccatgaaaccaagatgcccagtgaagaccgggacaaccttgccaggcccggcagtctaccaactcccgagccgagccgtagaggcagcaacacgctggtcggcagcccgcgtcagggcgacggattgcaaatgctcatggacgaattcgcagacgatgaatcctcagatacctcgtgggacattcacgagaccatcaggagtcgcacccaggccttggctgagaaggaccaccaggggatattctcaaatcagcggcgaggcaaccaggccgacgcgccagacacggtaaccagtgccaacgcttggttgccggctggcttcgaagacgacctggacgaagtgaccggtgctgacgacgagttcgagccaacccgtgggagtcgctggagagtgaggctggcgcccctggataccccttttcatcgccggatgcagaccctggtggttctgctacacgtcctcggcatgggaatcactttcagctttttctgcttcctatgcacgctccccctgttttggcctatcatcatcgcctacctcgtattcatcagactgtcgagagctggatccgatgggaagacaaaccgtcgcatagaatggctccgcagggctcgcatctggaagtactttgccgattacttccctgtcaagctacacaagacagccgacctgccccccacccgcaagtacatttttgcgattcatccacacggaatcatctcgcatggtgcctttgcctccttcgccacggaggccctcggcttctctgagaagtttcccggcatcacaaacagtgtgtgcactcttcacggcaacttcaagaccccgttctaccgcgagtatctgatggccatgggcctgatctcggtttcaaaggagtccattattaacactttgatgaccggcgggatcaacggtgaaggcatgggcagggccgtctccataattgtcggtggggcgcgagaggcactcgaggcctgccccaagacgatgcgcttgatactgaaacggcggggtttttgtcgcatggcactacgcaccggtgcagaccttgtgccggtgctctgctttggtgagaacgacctctaccaacagtgggggccgcaggatcatccgcgcttccgtcgcctgcaaatgaaggctctcgcgtacctaggctttgcggtccccgttctgaggggaaggggcgtcttcaactatgactttggagtccttcctcagcggcggccgatcaacgttgttgttggtgagcctatcaaggttgagcagtttcggggtagcggtaacattgagccacgcgtcgaggagctgtggaagctatattgccagaagcttcaggaactgtacgaccagaacaagcacgtctatttcaaggatcgtcaggaggatatgaggtttgttgactcggaggagttgtaa

SEQ ID NO: 23 - DNA, 1410 bp, Ciona intestinalis
gccataaaacgttgagaaaatgttttgtgttacgtcaagttactcattaactcaatgtaaagattgatatagccagagcaaattgtagttaagtagcgcatatacccaacttggaaactgctatatagttggtaaagcggattaggaaccatgtgggaattcgcaccgcttcgtattcctatgataagaagacttcaaacgttggctgtttctcattttgtgttctgctttcttgccttagctgccacatgcactttattgactatctacattactttgttcacttcatactggccgatcaccaccgcttaccttgtgttcttattcttggaccgaaacaccccggaatctggtggaagaagaagcgagtgggtgagaaattggagtctctggaaatggatgagcgattactttccttgtacgttgcacaaaaccgttgacctcgatccaaaaagaaactacatatttggcatccatccacatggggttttgtgcatcggatctttcactcacttctccacgaatggctccggattttcgcacgtttttccgggatttacatcttatcttacgatgttgcctttctggttcaaaatgcccttttttcgtgactatgttatgagcggcggtttgactccagccacaaggaaagccatcaaacacacaataacaaggccaggtggtgggcatatatgctgcattatacctggtggtgctccagaatctctaaacgcacggcctggagatgttgtattgttgctgaaacaaagacttggatttctcaagctggcaataacgaacggagttcctttggttcccgtgttttcatttggcgatcacgcgttgtgggagcagaaaccgaatccccccggttccctcatccgtaggttccaagatagctctcagaagtggatgcaagtcgctcttcccgttttccacgcacggggtatctttcagtacaattttggactaattccgtacaggcgtagcgtccataccgtagtgggcgagcccatagaagtgccacagaacagtaacccgacatcggaggaccttatgagtttgcaagaggattatattaatcgattgagagcaatttttgacgagcacaagagcaaatatctcccagaagattgcaaactgatcatcaactaaactaaactaaactatgcaaccaaagctttttaaattgagttagttatagtagtgtgaagtaagatagagcacctttagcaataatgctgtccaaatttcctggttcaaacaattaataacggacgggagtcgtgatgaaacggttttagaatactttaagtgtttttgtttactaccaaatgaaaagataaggtagaataaaagggtgtctcatcttcccccaccgtactatatatatacacgatcgaatcattg

SEQ ID NO: 24 - DNA, 1005 bp, Homo sapiens
atggtagagttcgcgcccttgtttatgccgtgggagcgcaggctgcagacacttgctgtcctacagtttgtcttctccttcttggcactggccgagatctgcactgtgggcttcatagccctcctgtttacaagattctggctcctcactgtcctgtatgcggcctggtggtatctggaccgagacaagccacggcaggggggccggcacatccaggccatcaggtgctggactatatggaagtacatgaaggactatttccccatctcgctggtcaagactgctgagctggacccctctcggaactacattgcgggcttccacccccatggagtcctggcagtcggagcctttgccaacctgtgcactgagagcacaggcttctcttcgatcttccccggtatccgcccccatctgatgatgctgaccttgtggttccgggcccccttcttcagagattacatcatgtctgcagggttggtcacatcagaaaaggagagtgctgctcacattctgaacaggaagggtggcggaaacttgctgggcatcattgtagggggtgcccaggaggccctggatgccaggcctggatccttcacgctgttactgcggaaccgaaagggcttcgtcaggctcgccctgacacacggggcacccctggtgccaatcttctccttcggggagaatgacctatttgaccagattcccaactcttctggctcctggttacgctatatccagaatcggttgcagaagatcatgggcatctccctcccactctttcatggccgtggtgtcttccagtacagctttggtttaataccctaccgccggcccatcaccactgtggtggggaagcccatcgaggtacagaagacgctgcatccctcggaggaggaggtgaaccagctgcaccagcgttatatcaaagagctgtgcaacctcttcgaggcccacaaacttaagttcaacatccctgctgaccagcacttggagttctgctga

SEQ ID NO: 25 - DNA, 1728 bp, Mus musculus
agcatggtggagttcgcccccctgttggtaccatgggagcgcaggctacagaccttcgcggtccttcagtgggtcttctccttcctggccttggcccagctctgcatcgtcatcttcgtaggcctcctattcacaaggttctggctcttctctgtcctgtatgccacctggtggtacctggactgggacaagccgcggcagggaggccggcccatccagttcttcagacgcttggccatatggaagtacatgaaggattatttccctgtctctttggtcaagacagctgagctggacccttcccggaactacatcgcgggcttccacccccatggagtcctagcggctggagcctttcttaacctgtgcactgaaagcacgggctttacctcgcttttcccgggcatccgctcctatctgatgatgctgactgtgtggttccgggcccccttcttccgagattacatcatgtctggggggctggtctcatcagaaaaggtgagtgccgatcacattctgtccaggaagggcggcgggaacttgcttgccatcatcgttgggggcgcgcaggaggcactggacgccaggcctggagcctacaggctgctgctgaagaatcgcaagggcttcatcaggctcgccctgatgcatggggcagctcttgtgccaatcttctcctttggagaaaacaacctgttcaaccaggttgagaacacccctggtacctggctgcgctggatccagaaccggctacagaagatcatgggcatctccctccctctcttccacggcagaggtgtcttccagtacagctttggcctcatgcccttccgccagcccatcaccaccatagtggggaagcccatcgaggtgcagatgacaccacagccctcaagggaggaggtggaccggcttcaccagcgctatatcaaggagctctgcaagctctttgaggagcacaaactcaagttcaacgtccctgaggaccagcatctggagttctgctaagtgtctccagccggaagacagctgcatctgagcgcctgcaggagtgtgggattagggggacttccacagccaccagacactcctacaaacctagccacaactgccaagatggaagagggggcagctcctaatcctgggatttgaacctgcagccaaagctctgaggtctccctgtccttggcctgtctgcacatctgtagaatgggggaaaagcaggcagagagaaattcctgaggtctcttcccacagttgtaatgtcattcaaacatgaccaaaggacaaacagggagaaagagaacaaaactgttcttcatctacccttgagggacagtgcaagagaagccagcaccccaggcctccctgtgcatgctccctgatgctgcttcttccctctgaggcagagacggggagccaagtctgccctggcacctactctatgtttcttcagattctgggtcctctgagctatgataccaaaggagcccagaaggcagataaggagggcaggggtcactgactatgaccgagggtaggtctccttcccatatcctgagcctcagtttccccagccttaatgacctgggagcgccacactgctcaccacagaggctccaccagagagcctcttactcatgctttctagtgaactccagcctctgtcttggcactgaagggcagcactgtacatgttacctcaataaatgaaaggagtctgtctta

SEQ ID NO: 26 - DNA, 1128 bp, Pan troglodytes
aaaaacctgtgggtgcctcagaccacagcagagctcacagaacctgcgggagccaggctgacccgccagcatggtagagttcgcacccttgtttgtgccgtgggagcgcaggctgcagacacttgctgtcctacagtttgtcttctccttcttggcactggctgagatctgcactgtgggcttcatagccctcctgtttacaagattctggctcctcactgtcctgtatgcggcctggtggtatctggaccgagacaagccacggcaggggggccggcacatccaggccatcaggtgctggactatatggaagtacatgaaggactatttccccatctcgctggtcaagactgctgagctggacccctctcggaactacattgcgggcttccacccccatggagtcctggcagtcggagcctttgccaacctgtgcactgagagcacaggtttctcttcgatcttccccggtatccgtccccatctgatgatgctgaccttgtggttccgggcccccttcttcagagattacatcatgtctgcagggttggtcacatcagaaaaggagagtgctgctcacattctgaacaggaagggtggcggaaacttgctgggcatcattgtagggggtgcccaggaggccctggatgccaggcctggatccttcacgctgttactgcggaaccgaaagggcttcgtcaggctcgccctgacacacggggcacccctggtgccaatcttctccttcggggagaatgacctatttgaccagattcccaactcttctggctcctggttacgctatatccagaatcggttgcagaagatcatgggcatctccctcccactctttcatggccgtggtgtcttccagtacagctttggtttaataccctaccgccggcccatcaccactgtggtggggaagcccatcgaggtacagaagacgctgcatccctcggaggaggaggtgaaccagctgcaccagcgttatatcaaagagctgtgcaacctcttcgaggcccacaaacttaagttcaacatccctgctgaccagcacttggagttctgctgagcccaaagggcagggccaacattagggagcccagcaggaggtgctgtgctgag

SEQ ID NO: 27 - DNA, 1005 bp, Canis familiaris
atggtgaagtttgcaccactgttcgtgccatgggagcgcaggctgcagaccttcatggtcctgcagtgggtcttctccttcctggccctggcccagatctgcactgtggtcttcgtaggcctcctgttcacaaggttctgggtggtcagcgtcctgtatgccgcctggtggtaccgggaccgggacacgccgaggcaggggggcaggcccgtccaagccctgaggcgctgcttcttgtggaagtacatgagggactacttccccgtcacgctggtcaagactgctgagctggacccctcccggaactaccttgctggcttccacccccacggggtcctggccgcaggagcctttgtcaacctgtgcacggagagcacgggcttccctttgctcttccctggcatccgctcccatctgatgatgctgaccttgtggttccgggtccctttcttcagggattacatcatgtccgggggcctggtcacttcggacaaggagagcgctgctcacatcctgagcaggaaggagggtggcaatctgctggccatcattgtagggggtgcccaggaggcgctgaacgccaggcctggagactccacgcttctgctccggaaccgcaagggcttcatcagacttgccctgatgcacggggcagctctggtgccgatcttttcctttggggagaatgagctatttgaccaggttgagaactctcctggctcctggttgcgtaggattcagaaccggctgcagaagatcatgggtatctccctcccgctcttccatggccgtggtgtcttccagtacagctttggctttataccctaccgccagcccatcaccaccgtggtgggaaagcccatcgaggtgcagaagacactgtgtccctcaaaggaggaggtggacaagctgcatcagcgctatgtcaaggaactgtgtgaactcttcgaaacccacaagctcaagtacaatgtccctgtggaccaacatttggagttctgctga

SEQ ID NO: 28 - DNA, 1820 bp, Bos taurus
gaggagccagcatggtggagtttgcacctttgtttgtgccactggagcgcagactgcagacctttgcagtcctgtactggatcttctgcttcatggtcttaccccctttatgccttgtggtcttcataggcctcctgttcacaagattctggctcttcaatatcctgtatgtgatctggttgtacttggaccaaaataggccacggcaggggggcagtcacaataagttcctaaagcgctgggtcctgtggaagtacatgaaggactatttccccatcacgctagtcaagaccactgagttggacccctcccggaactaccttgctgccttccaccctcatggactcctgtcagtcggagcttttaccaacatgtgcacagacagcacgggcttctcctcacttttccctggcatccgcccacatctgacaacgataaacatatatttcaggatcccactcttcagagattacatcatgcaaggggggctggtctcatcagacaaggagagtattgcttacattctgagcaggaaaggaggcggcaacctagtggccatcactgttgggggcatcagggaggcactgaaaaccaggcctggagccaacaagctggtgctgcggaaccgcaagggcttcatcaggctcgccctgatgcatggagcagttctggtgccgatcttctcctttggggacaatgaattatatgctaagacttctcctggcttttggtggaaatggttcagagatcaactgtacaagaagacacgtcttgccatcccgttcttctatggccgtggagtcttccagtacagttttggttttatgccctaccgccgacccatcaccaccgtggtggggaagcccatcgaggtgccgaagataccacatccctcccaagaggaggtggacaggctgcaccagcattacctgaaggagctgagcaacctcttcgaaacccacaagctcaagtacaacatccccaaagaccaacacttggagttctgctgagtacctccccagaggaggggcttgccccaaagggcagggctggcattaggaagggaggtgctgtgatcccagaaggtttcctggaggtatctgttgaacacatctccagagccttcactgactcctgcatctccaccccatgccaggccccaggtcacatctggctcatagaagaggagaccagactctggcatcaatgatttgctctcctccactaactcctctgtaacgggccctctctttggttctgcccacctgagaaatgggagagatactgggagaaaatgctgtctgtgtgtccgtcctctgtggtcctgtcactcaataagcaggacaaacagcagctccagtgagcaggtttcccttcctctgccttgagtgacagctggaagcagcccccagctgcagccctttctcctacaagctcccttatcctacatcctgcctgtcccatcttctccctccctgagccggagaggagggggagggcacaacctcctggctcatcctggcacctctgagtttctgagccccatatggcagccagaagggcctggaggtggggaagacctgagctctgtcactggctaaatgactgtacaccaacctcttcaacctccctctgagtctcagttttcccaaggactaaaatgacctctgacctcggctctaatcacacataggctgaaagctgcttatggtaactcctactctatcctttgtaattcagccctgaccttgggctccatatatgtcaattcatcacatgaaagattcgattttaaaaaaaaaaaaaaaaaaaaaaaaaaa

SEQ ID NO: 29 - DNA, 1774 bp, Rattus norvegicus
gtgtgtggagcctcctgagccagctcagcatggtggaattcgcccccctgttggtaccatgggagcgcaggctacagaccttcgcggtccttcagtgggtcttctccttcctggccttggcccagctctgtatcttcatcttcatcggcctcctattcacgaggttctggctcttctcagtcctatatgccacctggtggtacctggactgggacaggccgaggcagggaggccggcccatccaattcttcagacgcatggccatatggaagtacatgaaggatttcttccctgtctctttggtcaagacagctgagctggacccttcccggaactacatcgcaggctttcacccccatggagtcctggcggccggagcctttcttaacctgtgcactgaaagcacaggctttacctcgctcttcccaggcattcgctcctatctgatgatgctgactgtgtggttccgggcccccatcttccgagattacatcatgtctggggggctggtctcgtcagaaaaggtgagtgctgatcacattctgagcagaaagggcggcgggaacttgctagccatcatcgttgggggcgcacaggaagcactggatgccaggcccggagcctacaggctgctgctgaagaatcgcaagggcttcatcaggctcgccctgacacatggggcagctcttgtgccgatcttctcctttggggagaacaacctgtttaaccaagttgagaacacccctggcacctggctgcgctggatccagaactggctgcagaagatcatgggcatctcccttccgctcttccatggcagaggtgtcttccagtacagctttggcctcgtgcccttccgccagcccatcaccaccgtagtggggaagcccatcgaggtgcagatgataccacatccctcggaggaggaggtgaaccggcttcaccagctctatatcaaggagctatgcaagctctttgaggagcacaaactcaagttcaacgtccctgaggaccagcatctggagttctgctaagtgtctccagccggaagacagctgcatctgagcgcctgcaggagtgctgggatgagagggatttccacagccaccaggaactcctaggagcccagccacagctggcaagatggaggcagttcctaaccctgggattcgtccctgcagccaaagctctgagctctccctgtccttggtctgcacatctgtagaatgggggggaaagcaggcagagagcaattcctgaggtctctctccacagttgtaatgtcattcaaacatgaccaaaggacagccatggagaaagagaacaaaattgttctttacctacccttgagggacagtgcaagaggagccagcaccccaggcctctctgtacatgccccctggatgcctcttcttaccctctgagctggagaggggaagccatatatgccctggcacccactctatgtttcttccagattctgagtcctctgagctatgacatgaaggagcccagagacagttaaggaggacagagctcactgactatgaccgaggttagatctccttcccatgtcctgagcctcggtttcctcagccttaatgacctgggagccacacctctcacatcacagaggctcccccagggagcctcttactcatgctttctagtgaactctagcctctgtcttggcacaaaagggcagtgctgtacatgttgcttcaataaataaaaggagtctgtcgtaaaaaaaaaaaaaaaaaaaaaaaaaaaa

SEQ ID NO: 30 - DNA, 1056 bp, Gallus gallus
atggagcgtgcctataaaatctgtgatgacaccacgtccaaaagactgaaaaacctcttctgggctgtgcagaacgggtccccccaggtgagccgttcctctcccaccaccctcaccgctcaccgcctggcttttctcccagcacagtgctgcaccgctgccttcatcggcctcctcttcacccgcttctggctgctcagtgtcctctatgccgcctggtggttcgtggacagggaagcaccgctcaggggtgggcgacggatccacatggtgcggaacagcgcagtctggagacacatgagggacttcttccccgtcacgctggtgaaaacagcagagttggaccccaggcagaactacttggtgggatttcacccccacggggtcctggcagtgggagccttcatcaattttggaacagaggcgacaggcttttccacgatcttcccaggcatcaccccacacctgatgatgctctccttatggtttcgtgtccccttcttaagggactacctgatgagcggaggccttgtgtcctctgataaggagagtgcgtaccatgtgctgcagaggccagagggggggaacctgttggccatcatcgttggtggggctcaggaggctctggatgcccggccaggatcctgcaccttgctgctgaagaataggaagggatttgtccgcgtggccatcgagcagggcaccccactggtccctgccttttcctttggggagaatgagctcttcgaccaggtgagcaaccccaagggctcgtggctgcggtggatccagcaccggctccagcagatcatgggcatctccctacccctcttccacgcaagaggtatcttccagtacagcttcgggctggtgccctaccgccggcctatcaacaccgtgattgggaagccaattcccgtgctgaagaagcacaagccaacggaggaagaggttgatcgagtccataagaaatacttagaagagctgagcaagctctttgaggagcacaaagctaaatacaacgtcccagaagacagtcacctcgaatttatatag

SEQ ID NO: 31 - DNA, 1287 bp, Danio rerio
gtgtttggttcagaatgacccagtaaacttgttcatttgtggagcctgtgggaataagtaaacaaatcatacctggatctttgagttctccagagctggattttactcgccctgctgtattgtcctgttcttcatcctgctcttcacccgtttctggctcatcagtgtgctttatgccacctggtggtacatcgactgggacacaccttcacgaggagggagaatagtgccatatctctgcaaactgcgtgtgtgggagtacatgagagattatttccccatcaggctgataaagacggctgacttggacactaggaagaactatgtgatgggttttcatcctcatggtattctcgtggctggtgcttttacaaatttctgcacggaggcgactggatttagcaaactcttccctgggataaagagcaaccttcttatgctgcctctctggttcagagcccccttcttcagagattacatcatgtcagcagggctggttccatcagacaaggagagtgccagttatctgctccggaggaagggcggagggaatgcggtggtcattgcagtcggtggagctcctgaagctttggatgcacatcctggtgactacaccgttcacctggccaataagaaaggctttattaagcttgcaatagagcacggtgcagatttggttcctatatattcgtttggagagaacgaggtgtttgaccaggtgcagaatcctcgtggcacatggctgcgatacattcaagagcgtctgcagcgcatcatgggtgtttctcttcctctctttcatgcgcgaggagttttccagtacaccttcggcctgatgccttacagaaagcccatcaacactgttgtgggaaggccaattccagtggagaaaaatgagaaaccaacagcagaagaattggacgtctatcatcagcgctatatggatgaactggcacggctgttcgaggaccacaagggaaattatggagtacctgaagacactcatctggtgttccagtgagatgatcacttatgttgacgatgagtttgtgtgtttgtaccttgtatttcttacattgtaggaaccaaatgtcttcacatatatagacataccactacatttgaccttgtggggacatttgtttggttctaatgttcaaaatggctcatgaatcatgctgaatttaatatttagaaaatgtaaaaatgccgattgttttctgtgagggttgggtttaggggtagaaaaaaaaccaaaaaaaaaaaaaaaaaaaaaaaaaaaaaaaa

SEQ ID NO: 32 - DNA, 1268 bp, Drosophila melanogaster
ccgagagccgataaggataagtataagtctagtacagggcaatttgaccatcgctggcttccatatcattcagtcgtgggagaaccgccgaaagagcagctggtggagtttttttgggcatttttgtaacacagcagacatgaaaatcgagtgggcaccactgcgggttcctctggaacgccgactgcagatactggtcacggcctttttcacctccatgctgctgatactattgtcagtttccttccttttggtagctggatcactgatctacggaggtcttttggtgcgtagtctgatggtaacttacttggcctacgtctttgtgcaccacaagaaaacccaatccgttgtggatggcaatggctggatgataacacgcaccaaccttttgcatcgccactatcgtgattactttcccgtggagctggtgaaaacagccgaactgccagctactaagaactacatcttggccagctttccccacggaattctgggcacaggcattggcattaacatgggcttggaaatctccaagtggctggagctattcccccaagtgcgtcccaaactgggcactctggatcagcatttccatgttccgttcatgcgtgaggtcctccgctgctggggtctggtgtcagtgtccaaagaggcgctgatccgtatgctcagcaagtcaaatgatcccaagcacaaggataatcgggatggtttcacctccaatgcggtggccattctggttggcggtgcccaggaagccatggactctcatcctgggcagtacattttaaccttgaagaataggaaaggcttcgtgcgaatggccattagaacgggctcatcgattgttccttcattttcctttggagaggtggacattttcgatcaggtggcaaatccccccaactcgctgctccgacggtttcaggactttgtcaagaagctcaccggagtctctccgctgattcctgtgggccgcggattcttcaactacacctttggcttcctcccattccgacgacgcattgtccaagttgttggtgctcccatcgatgttgttaagaacgagcacccagactcggagtatgtggataaagtgcatggacaggtcattgagtcgctggagaagttattcgatcagtacaaagacaagtacttggagaattcgaagagtgccactctagttgtacactagttttaaatcatgttgatacaaaatattcctatgtattgaaatagaaacgagctttttaattgaatttaaa

SEQ ID NO: 33 - DNA, 1269 bp, Drosophila melanogaster
agttaaatgttgtacgctcgcatcgtcggttctgctgctcaaacgcgataacgatccattactcgccggaggaccgtgctaccaagtagttcaactttccgagttcgagagctctgacatcatgaaaatcgagtgggctcccaaaggagttcccatggaacggcgtcgccagacgtttgccatggccttcctaatcctatcctttatgatactctcctttggatcctatttcttcgttgctgccgtgctgttctatggaagccttttgtggcgcaccattatggtcatctatttggtctacgtctacgcgaatcacaagagaacccactccattatggatggcaatggctggaaaattaaccgcaacaattggctgtttcggcattatcgggactactttcccgtacagctggtcaagaccgcagagctgccgccgaataagaactacattttggccagttttccgcacggaattttggggactggcatttccattaatatgggtctagacatctccaagtggctgcaactgttcccacaggtgaggcccaaggtggccactttggatcaaaacttcctgacgcccatcgtgcgtggtctcctgagatcttggggcctggtgtcggtttccaaggaggccttagtatatctgctaaccaaatcaaacgatcccaagcacaaggacaatcgtgatgggttcacctccaacgcggtggctattctggtgggtggtgcccaggaggcactagactcgcaccctggcaaatatatattgacactgaagaaccgcaagggattcgttaaaatggccattaggacagggtcttcgattgttcccacgttttcctttggcgaggtggacattctggatcaggttgccaatccaccgaactctcgggttcgtcgctttcaagactttgtaaagaggataacggggatatctccgctgattcccgttggccggggcatcttcaactactcctttggctttctgcccaaccgtcgacgcattgtccaagttgttggcgctcccatcgacgtggttcagagcgatcaaccagacgcagcctatgtggataagatacacaaacaggttattgacgacctggagaagatgttcgccaagtacaaggatcagtacataccgaactccaagcaggacaagctgattatacactagtcgagaagttattgtctaaacaatgtgatcaaatgagtgctttataagcatttaatataaaaattacgaattttatcaggcaaataaaa

SEQ ID NO: 34 - DNA, 1139 bp, Drosophila melanogaster
atgacaatcgaatgggctcctctccgggttccgctggaacggcggcttcagaccctggttacgtcattcttcacctataccttctttacgctgcccatctcgtcctgcctcgcagtagctatcctgctgtactacggcgaaatgtttgtgcgtagtctgcttcttatctattttgtgaaaatttatttggattataaaagaaattacggcattatggaaggtaatggttggttattctaccgcagcaattggagatatcgaaactacttccccgtcgaacttgtaaaaaccgccgagctgcctcccaacaggaactatatcgtagcaagctttccacacggaatacttggtactggaacttgcattaacatgagcctggacatcgacaattggctatccctttacccgcacgttcgacccaagatcgccaccctggatcatcacttcaagacgcctttcctgcgtgacatattgcgctggtggggcatggtatcggtttccaaggaatccctgtcctatttactcagcaagtcaaatgatccaatgcacaaggataatcgggatggtttcacatccaatgcggtggccgtacttgttggtggcgccaaggaagccatggattcgcatccgggacagtacattttgaccctcaaggatagaaagggtttcgtcaaaatggctgttcgaaccggatcgtcgattgtgccctcgttgtcctttggcgaggtggacatatttgatcaggtggctaatcctccggactcctcgctccgtcgcttccagaatgtggtcaagaaattcacaggcatttcaccgctccttcccaagggtcgcggtatcttcaactacaactatggcattctcccacatcgacgacgtattgtccaagttgttggttcccccatcgatgtggaaagatgcgagactcccgatcccgaatatgtggacaagatccatgggcaggtgatcgacgcgctggcgaggatgttcgatgaatacaaagagaagtacactccaaactcaaagcatatcaaacttataatacagtgactcagtagagtcccttagattgtgattttttatagaattaaggaaacttttgaaacgcaacacagttttagactaatttaaaaaaaaaa

SEQ ID NO: 35 - DNA, 1971 bp, Anopheles gambiae
cgcatgaggagaaaagttggccactcagttattatacgcgacaagctcccagtataagcgtcattgttagatcgcattctacaatgacaaacggacccgacatcattagtcatgtttggccggtggtcagaagaaagcacagagggtggaagaaaagctgattcattgggtgaggacgttagtctgcgggcgtgtttttatcgtctcagtttgcatcatgccccagtgaaagtgataccgacacgacatttggtgaagccattcggttcaagattaagggacaggctaaaccagtacaagtgagtattcgttgattcattcgtaaaccgaacgttgtttgctcagcaagaagcaatgactgataagtgataacgtaattgcatcatcggcatcaatgctgataagatctcgagctgcgggaaggaaaacgcatcaagtggtacatcgtttgtggtgtgatagattttgggagggcgagtcgtagtggtggaacatcccccggtaccggttctagacgcgctcaccaaaacctaagatgggtaaaatcgaatgggccccactgaatgtgccgatgaggcggcggatcgaaaccctgtccactgccctgtggatgtggctgatactgttcggcgagctgggcatgctgatatcgtacttcctgctgctgatctatggtaacttgtttattaaatcgctgtgcgtcatctacggatacttcatctacactgatcgaaaagtgactttgaacgggggccgtggacagggtgtaacatggtggcgagagctgttctggtggaagctctaccagagctacttcccggcgaagctgcacaaaacggttgatctcgaccctaaccggaactacctgtttgccgccttcccgcacggcgtgcttggcctcggtgccttcatcaactttgccaccaatgcgaccggctttcacgacaagtttcccaaaatccgttcccgcccggtgacgctaaacttccactttgtgataccgttcttccgcgagctgctgctcagctggggcctcgtgtcggccaacccgaacagcatcctgagcctgctgaaggcgccgaacaaaccggaccacccgctgaacgacgacggctacacggccaacgcggtcgtgatagtggtgggcggtgcggccgaatcgctgcactgccggccgaacaactacacgctggtgctgcgcaagcggaagggcttctgcaagctggcgatcaaggcgggcaccccgctggtgccggtgatgacgttcggcgaggtcgacctgttcgatcagccgccgaatccgcccggctcgcggttgcgccggttccaggagtttgtgaaaaacacgaccggcatcgcgccggccgccttcgtcgggcggggcttcttccagtacagctacgggttgatcccgcgccggaagccactgaacacagtcgtcggtgctccggtggaggtgacgcaaatagacaacccgacgcaggaacaggtggatgaggtgcacgagcggttctgccgcgcgctggacaatctgttcgaaacgaacaaatcgcgcttcattgccgactacaagaatgtgaagcttgtcatggagtaataggtaaaatgcagatacttcccgtacttcccgccatctttacacacaaacgatcggtgtatagcggtgggaaaacggggcaaaatcacgcacaagagacacagaaacacactatcatcacgatatcctacgcaacccgtggaaattgtgttataattcgcatcgtaaggattgagactgtaccaaaaaaaaaaaaaaaacgaacgatcaaaaccaactcttttcatacctaagatccaaccattgtgcggtgccaacaggtgatattgttatacagctctgcgagagggagtcaattactagctgcgtaagagaggacacactacattgggagtgtttagcatttaaattctcgtgtaagtgtaattgtgtaa

SEQ ID NO: 36 - DNA, 1612 bp, Anopheles gambiae
gtcacattctaaccttacgcccgtgctgaaccccaggggagaccagtgcgcgctccactgtgaactccctagtgtgtagtgtattcttttcctgttgttttagatgtattaagggcgagtcgtagtggtggaacatcccccggtaccggttctagacgcgctcaccaaaacctaagatgggtaaaatcgaatgggccccactgaatgtgccgatgaggcggcggatcgaaaccctgtccactgccctgtggatgtggctgatactgttcggcgagctgggcatgctgatatcgtacttcctgctgctgatctatggtaacttgtttattaaatcgctgtgcgtcatctacggatacttcatctacactgatcgaaaagtgactttgaacgggggccgtggacagggtgtaacatggtggcgagagctgttctggtggaagctctaccagagctacttcccggcgaagctgcacaaaacggttgatctcgaccctaaccggaactacctgtttgccgccttcccgcacggcgtgcttggcctcggtgccttcatcaactttgccaccaatgcgaccggctttcacgacaagtttcccaaaatccgttcccgcccggtgacgctaaacttccactttgtgataccgttcttccgcgagctgctgctcagctggggcctcgtgtcggccaacccgaacagcatcctgagcctgctgaaggcgccgaacaaaccggaccacccgctgaacgacgacggctacacggccaacgcggtcgtgatagtggtgggcggtgcggccgaatcgctgcactgccggccgaacaactacacgctggtgctgcgcaagcggaagggcttctgcaagctggcgatcaaggcgggcaccccgctggtgccggtgatgacgttcggcgaggtcgacctgttcgatcagccgccgaatccgcccggctcgcggttgcgccggttccaggagtttgtgaaaaacacgaccggcatcgcgccggccgccttcgtcgggcggggcttcttccagtacagctacgggttgatcccgcgccggaagccactgaacacagtcgtcggtgctccggtggaggtgacgcaaatagacaacccgacgcaggaacaggtggatgaggtgcacgagcggttctgccgcgcgctggacaatctgttcgaaacgaacaaatcgcgcttcattgccgactacaagaatgtgaagcttgtcatggagtaataggtaaaatgcagatacttcccgtacttcccgccatctttacacacaaacgatcggtgtatagcggtgggaaaacggggcaaaatcacgcacaagagacacagaaacacactatcatcacgatatcctacgcaacccgtggaaattgtgttataattcgcatcgtaaggattgagactgtaccaaaaaaaaaaaaaaaacgaacgatcaaaaccaactcttttcatacctaagatccaaccattgtgcggtgccaacaggtgatattgttatacagctctgcgagagggagtcaattactagctgcgtaagagaggacacactacattgggagtgtttagcatttaaattctcgtgtaagtgtaattgtgtaa

SEQ ID NO: 37 - DNA, 1017 bp, Tribolium castaneum
atgaagattttggggatcaagttcgcccctttgcacatccccctcgagcgccgcttgcaaacccttgccgccggatgctggttcacaaccctggcctttggtaccttcatcggtaccttcatctgggtgtacgtcttcttcacccgattctggtacctgtccgtcctttacgccaccataatatacctcgagaaaagcaagtgtgagaagggcggccgccccatcgaatggatcagacattggggatggtggtactacttgaaaaactacttcccctgtaagcttgactttgtcccgggcctaacctttgatccgaagaggaattatctatttgcctgttacccccatgggatcctcccggcgggccctttcaacaccattggtagcccttacagcgaatttagcaagttgtttccaaagtttcgggtgaggttggtgattctgcaccaacatttcttcattccgtttctgcgggagattgcttatgggacaggggggatttcggcctcggccaagtcgttgaatcatgttttggggagtccggaaggggggtatattgcggtgttgatgcccgggggcgcagttgaggcctataacagccggcctggacagtacagaatcatcctgaagaacaggaaaggcttcgtaaaactggccttgaggaatgggtcaccactagtaccagttatctcgttcggggagccggaattgtttgatcaagttgaagggaggactttgaggaagattcaggagtccatcaggaagtacctcgggctggcacctgtgattttctcagggagagggttcttccagtactcgtttggcgttattccacaaaggaggcctattacgaccgttgtcgggcacccgattgaagttaccaaaatcgaaaaaccaacaaacgaggaagtggacgaactacataaaaagtacatgcaagagctggagaacttgttcgaagagtacaaattcaaatatttggagaatccgaaggacatacacttggagtttgaataa

SEQ ID NO: 38 - DNA, 1420 bp, Homo sapiens
cactcacacacctacggacacacgctactctgggaggtgatttgcgacttagccaggcccccaaagctgggctcctgtagggagaaagtctgcccaggtccacatccaagccttcatcgtttgtcctccgggttctgggatcctgctggaagaggggagcttctgcaatgggagttgccacaaccctgcagcccccaaccacttccaaaaccttgcagaagcagcatctagaagcagtgggcgcctaccaatatgtgctcactttcctcttcatgggccctttcttctcccttcttgtctttgtcctcctcttcacgtcactctggcccttctctgttttttacttggtgtggctctatgtggactgggacacacccaaccaaggtggaaggcgttcggagtggataaggaaccgggcaatttggagacaactaagggattattatcctgtcaagctggtgaaaacagcagagctgcccccggatcggaactacgtgctgggcgcccaccctcatgggatcatgtgtacaggcttcctctgtaatttctccaccgagagcaatggcttctcccagctcttcccggggctccggccctggttagccgtgctggctggcctcttctacctcccggtctatcgcgactacatcatgtcctttggactctgtccggtgagccgccagagcctggacttcatcctgtcccagccccagctcgggcaggccgtggtcatcatggtggggggtgcgcacgaggccctgtattcagtccccggggagcactgccttacgctccagaagcgcaaaggcttcgtgcgcctggcgctgaggcacggggcgtccctggtgcccgtgtactcctttggggagaatgacatctttagacttaaggcttttgccacaggctcctggcagcattggtgccagctcaccttcaagaagctcatgggcttctctccttgcatcttctggggtcgcggtctcttctcagccacctcctggggcctgctgccctttgctgtgcccatcaccactgtggtgggccgccccatccccgtcccccagcgcctccaccccaccgaggaggaagtcaatcactatcacgccctctacatgacggccctggagcagctcttcgaggagcacaaggaaagctgtggggtccccgcttccacctgcctcaccttcatctaggcctggccgcggcctttcgctgagcccctgagcccaaggcactgagacctccacccactgtggactccatgcctccaataaaaggtagttctgggcccagcgcagtgcctcgtgcctgtgatcccagcactttgggaggccagggtgggaggatcgtttgagcccaggagttgaagaccagcctgggcaacacagtgagacttcatttctacaaaaaaaaaaaaaaa

SEQ ID NO: 39 - DNA, 1934 bp, Pan troglodytes
ccactcacacacctacggacacacgctactctgggaggtgatttgcgacttagccaggcccccaaagctgggctcctgtagggagaaagtctgcccaggtccacatccaagccttcatcgtttgtcctctgggttctgggatcttgctggaagaggggagcttctgcaatgggagttgccacaaccctgctgcccccaaccacttccaaaaccctgcagaagcagcatctagaagcagtgggcgcctaccaatatgtgctcactttcctcttcatgggccctttcttctcccttcttgtctttgtcctcctcttcacgtcactctggcccttctctgttttttacttggtgtggctctatgtggactgggacacacccaaccaaggtggaaggcgttcggagtggataaggaactgggcaatttggagacaactaagggattattatcctgtcaagctggtgaaaacggcagagctgcccccggatcggaactacgtgctgggcgcccaccctcatgggatcatgtgtacaggcttcctctgtaatttctccaccgagagcaatggcttctcccagctcttcccggggctccggccctggttagccgtgctggctggcctcttctacctcccggtctatcgcgactacatcatgtcctttggactctgtcccgtgagccgccagagcctggacttcatcctgtcccagccccagctcgggcaggccgtggtcatcatggttgggggtgcgcatgaggccctgtattcagtccccggggagcactgcctaacgctccagaagcgcaaaggcttcgtgcgcctggcgctgaggcacggtgggccgccccatccctgtcccccagcgcctccaccccaccgaggaggaagtcaatcactatcacgccctctacatgatggccctgcagcagctcttcgaggagcacaaggaaagctgtggggtccccgcttccacctgcctcaccttcatctaggcttggccgcggcctttcgctgagcccctgagcccaaggcactgagacctccacccactgtggactccatgcctccaataaaaggtagttctgggcccagcgcagtgcctcacgcctgtaatcccagcactttgggaggccaaggtgggaggatcgtttgagcccaggagttgaagaccagcctgggcaacatagtgagacttcatttctacaaaaattaaaaaataatgttgttaattagccgggcatggtggcatgtgcctgtaatcccagctatttgggaggctgaggcaggagacttgcttgaacccaggaggcggaggttgcagtgagctgagatcacaccacagtactccggcctgggcaacacagcgagactcaatctcaaaaaaaaaaaaaaaaaaaaaaaaagatggttaaagctatagtaggctgggcgtggtggctcatgcccataatcccaacactttgggaagccaaggcaggtggatcacctgaggtcaggagttcaagaccagcctggccaaaatggcaaaaccccctctctactaaaactacaaaaattagccgggcatggtggctcatgcctataatcccaggtactccggaggctgaggcaggagaatcgcttgaacccaggaggcagaggttgcagtgagccgagatcacaccactgcactccagtctgggcaacagagcgagattccatctcaaaaaaaaaaaaaaaatgttgttaaagctataatcattctggaagtgaacatggccaggcatgacctgcccccatcctgatgtgctacaaagctgctgccttagattgggtatcaggaccctgaactgtcctcccagtgagagttcagtctgtggcatgaccttggacaagcctcttccttttgcctgtttacttctttgtctgtaaataaaggcatctgcttagcaaaga

SEQ ID NO: 40 - DNA, 2223 bp, Pan troglodytes
ccactcacacacctacggacacacgctactctgggaggtgatttgcgacttagccaggcccccaaagctgggctcctgtagggagaaagtctgcccaggtccacatccaagccttcatcgtttgtcctctgggttctgggatcttgctggaagaggggagcttctgcaatgggagttgccacaaccctgctgcccccaaccacttccaaaaccctgcagaagcagcatctagaagcagtgggcgcctaccaatatgtgctcactttcctcttcatgggccctttcttctcccttcttgtctttgtcctcctcttcacgtcactctggcccttctctgttttttacttggtgtggctctatgtggactgggacacacccaaccaaggtggaaggcgttcggagtggataaggaactgggcaatttggagacaactaagggattattatcctgtcaagctggtgaaaacggcagagctgcccccggatcggaactacgtgctgggcgcccaccctcatgggatcatgtgtacaggcttcctctgtaatttctccaccgagagcaatggcttctcccagctcttcccggggctccggccctggttagccgtgctggctggcctcttctacctcccggtctatcgcgactacatcatgtcctttggactctgtcccgtgagccgccagagcctggacttcatcctgtcccagccccagctcgggcaggccgtggtcatcatggttgggggtgcgcatgaggccctgtattcagtccccggggagcactgcctaacgctccagaagcgcaaaggcttcgtgcgcctggcgctgaggcacggggcgtccctggtgcccgtgtactcctttggggagaatgacatctttagacttaaggcttttgccacaggctcctggcagcattggtgccagctcaccttcaagaagttcatgggcttctctccttgcatcttctggggtcgtggtctcttctcagccacctcctggggcctgctgccctttgctgtgcccatcaccactgtgggtgagtgcccacctccggggggacggccaccagcagctgcgtgggcatcagggatccctcgcccacctgtctccctctccctgcagtgggccgccccatccctgtcccccagcgcctccaccccaccgaggaggaagtcaatcactatcacgccctctacatgatggccctgcagcagctcttcgaggagcacaaggaaagctgtggggtccccgcttccacctgcctcaccttcatctaggcttggccgcggcctttcgctgagcccctgagcccaaggcactgagacctccacccactgtggactccatgcctccaataaaaggtagttctgggcccagcgcagtgcctcacgcctgtaatcccagcactttgggaggccaaggtgggaggatcgtttgagcccaggagttgaagaccagcctgggcaacatagtgagacttcatttctacaaaaattaaaaaataatgttgttaattagccgggcatggtggcatgtgcctgtaatcccagctatttgggaggctgaggcaggagacttgcttgaacccaggaggcggaggttgcagtgagctgagatcacaccacagtactccggcctgggcaacacagcgagactcaatctcaaaaaaaaaaaaaaaaaaaaaaaaagatggttaaagctatagtaggctgggcgtggtggctcatgcccataatcccaacactttgggaagccaaggcaggtggatcacctgaggtcaggagttcaagaccagcctggccaaaatggcaaaaccccctctctactaaaactacaaaaattagccgggcatggtggctcatgcctataatcccaggtactccggaggctgaggcaggagaatcgcttgaacccaggaggcagaggttgcagtgagccgagatcacaccactgcactccagtctgggcaacagagcgagattccatctcaaaaaaaaaaaaaaaatgttgttaaagctataatcattctggaagtgaacatggccaggcatgacctgcccccatcctgatgtgctacaaagctgctgccttagattgggtatcaggaccctgaactgtcctcccagtgagagttcagtctgtggcatgaccttggacaagcctcttccttttgcctgtttacttctttgtctgtaaataaaggcatctgcttagcaaaga

SEQ ID NO: 41 - DNA, 2137 bp, Pan troglodytes
ccactcacacacctacggacacacgctactctgggaggtgatttgcgacttagccaggcccccaaagctgggctcctgtagggagaaagtctgcccaggtccacatccaagccttcatcgtttgtcctctgggttctgggatcttgctggaagaggggagcttctgcaatgggagttgccacaaccctgctgcccccaaccacttccaaaaccctgcagaagcagcatctagaagcagtgggcgcctaccaatatgtgctcactttcctcttcatgggccctttcttctcccttcttgtctttgtcctcctcttcacgtcactctggcccttctctgttttttacttggtgtggctctatgtggactgggacacacccaaccaaggtggaaggcgttcggagtggataaggaactgggcaatttggagacaactaagggattattatcctgtcaagctggtgaaaacggcagagctgcccccggatcggaactacgtgctgggcgcccaccctcatgggatcatgtgtacaggcttcctctgtaatttctccaccgagagcaatggcttctcccagctcttcccggggctccggccctggttagccgtgctggctggcctcttctacctcccggtctatcgcgactacatcatgtcctttggactctgtcccgtgagccgccagagcctggacttcatcctgtcccagccccagctcgggcaggccgtggtcatcatggttgggggtgcgcatgaggccctgtattcagtccccggggagcactgcctaacgctccagaagcgcaaaggcttcgtgcgcctggcgctgaggcacggggcgtccctggtgcccgtgtactcctttggggagaatgacatctttagacttaaggcttttgccacaggctcctggcagcattggtgccagctcaccttcaagaagttcatgggcttctctccttgcatcttctggggtcgtggtctcttctcagccacctcctggggcctgctgccctttgctgtgcccatcaccactgtggtgggccgccccatccctgtcccccagcgcctccaccccaccgaggaggaagtcaatcactatcacgccctctacatgatggccctgcagcagctcttcgaggagcacaaggaaagctgtggggtccccgcttccacctgcctcaccttcatctaggcttggccgcggcctttcgctgagcccctgagcccaaggcactgagacctccacccactgtggactccatgcctccaataaaaggtagttctgggcccagcgcagtgcctcacgcctgtaatcccagcactttgggaggccaaggtgggaggatcgtttgagcccaggagttgaagaccagcctgggcaacatagtgagacttcatttctacaaaaattaaaaaataatgttgttaattagccgggcatggtggcatgtgcctgtaatcccagctatttgggaggctgaggcaggagacttgcttgaacccaggaggcggaggttgcagtgagctgagatcacaccacagtactccggcctgggcaacacagcgagactcaatctcaaaaaaaaaaaaaaaaaaaaaaaaagatggttaaagctatagtaggctgggcgtggtggctcatgcccataatcccaacactttgggaagccaaggcaggtggatcacctgaggtcaggagttcaagaccagcctggccaaaatggcaaaaccccctctctactaaaactacaaaaattagccgggcatggtggctcatgcctataatcccaggtactccggaggctgaggcaggagaatcgcttgaacccaggaggcagaggttgcagtgagccgagatcacaccactgcactccagtctgggcaacagagcgagattccatctcaaaaaaaaaaaaaaaatgttgttaaagctataatcattctggaagtgaacatggccaggcatgacctgcccccatcctgatgtgctacaaagctgctgccttagattgggtatcaggaccctgaactgtcctcccagtgagagttcagtctgtggcatgaccttggacaagcctcttccttttgcctgtttacttctttgtctgtaaataaaggcatctgcttagcaaaga

SEQ ID NO: 42 - DNA, 1749 bp, Canis familiaris
atgacgttccctgaccccaagacgggacagtgctgcctctctccggtcctgtccgggcctgggggcggccgggtggccctgctggccctgggagggcccctggaagcgctggaagcaaaacccggcgcgctgttttgcggatccggaatcagaagagatttgtccagctggcaccgggacacggagcgagctcttccagccgttcgcgaaccctccggacccttgggcctccttctgcccttccgggcgcgcccatccacccggtccgggagtcccagcctctgccccctcggctcccctgcgcgcaccagctccgcagcgctcgggccagcgcgctccccgcgccggggcgggaaccccgcgctgctgcccacgcctgggcacaccggctcacctcttttgacactcccagtccctgactctgtcgagacggtcgcgcgtggcaatgaagaggccgggcggtgccggggatcccgttctgcgcgcatggcgcggctcacgcggctgttccgggagcgcaaggcgcgcgccggcctcccgggccacccgcacctccccgccgtgtccctgaggtgccgacactcccggggacctgcacacggagccggggcgcgcaccaggggcctgcccggccacgctgggccccggaggcgtggagcgtttggtcgctccagcaagaaagccttcactccgtgcccaaaccttcgtcgtttgcgctccaggccctggaaccccactggcggaggggagcgccccaccatgagaaccacgcagaaacagtggctagaagccttaagcgtctcctattacgtgttcactttcctcttcatgggccttttcttctcccttcttgtcctcttcctcctcttcacttcattctggtccatctctgttctctacttggtgtggctcttcctggactgggacacacccaaccaaggtgggaggtgctttgagtgcaacaggagctgtaccatttggaaacacttgaaggattattttcctattaagctggtgaagacagcagagcttccccctgaccggaactatgttgtgggttgtcacccacatgggatcatgtgcatgggaaccttctgcaatttcttcacggaggccaacaacttctccaagcagttcccggggattcagacatcacccgtaacactggcctttctcttgcacctcccagtctatcgtgactacctcatgtaccttggactgtgttctgtgaaccgccggagcctggactttattttgtccaagccccagcccgggcaggcggtagccatcgtagttgggggtgcccacgagtccctgtttgcgatcccagggatgcactgcctcgttctccggaaccgcaaaggcttcgtgcgcctggcactgaggcacggagcttccctggtacctgtgtactcctttggggagaatgatatcttcaattttaaggcttttcccacaaactcctggcagtatctgtgccagatcaccatcaagaagatcatgaaattttctccttgcatcttctggggccgcggactcttctcagctgactcctggggtttactgcccttcgccaagcctatcaccactgtggtgggccgccccatccctgtgccacagcgcctcaaccccactgaggaggaagttgaccactatcacatgctctacatggaggctctagagcaactgtttgaggaacacaaggaaagctgtggtgtcccagcctctactcacctcatctttaaatag

SEQ ID NO: 43 - DNA, 1221 bp, Bos taurus
atgataagtgagagcagactggagacctctggggctctgatgagagagtctccccacgcacacagccccctacaagcgatcctgggaggctcccaagcgcttggccactcagaccagaaagatttcctgcgctccaaccaaagccttcatcccatttttcctggttcggaagccctgctggctgaaggggagcacctgggagtctccaccaccccaccacccacccccagcatgaaaaccttaaagaaacagtggttagaagtactgagcacctaccaatatgtgctctgtttcctcttcctgggccctttcttttcccttgttggcttcttcctcctcttcacctcgctctggtatctctctgttctctacttggtatggttattcctggactgggacacaccccagcaaggtggaaggcgtaatcagtggttgaagaactgcactgtgtggaaacacctgagcgattatttccccattaagctggtgaaaacagtagagctgcccccagacaggaactacgtgctattgtcccacccacatgggatcatgggctttggaaccgtctgtaacttcagcacggagggcactggctgctcgcagctgttcccagggcttcggttctcactggccgtgttgaattgtctcttgtacgtgccaggctgtcgagagtacattatgtcctgtggaacatgttctgtgaaccgtcagagcctggattatgttctatctcaaccacagctcggcagggctgtggtcatcatggtcggaggggccaatgaggccctgcataccgtcccaggggagcactgcctcactctccggaatcgtaaaggcttcgtccgcctggcactgaggcacggtgcctccctggtgcccgtgtactcctttggggagaatgacgtcttcagagttaaggcttttgccccagactcctggcagcgtctgttccaggtcaccatcaagaggctcctgagcttctctccttgcatcttctggggccgtggtctcttctcagccaagtcctggggcctgatgcccctcgccagacccatcaccactgtggtgggccgccccatcccggtgccccagtgtccacagcccaccgaggagcaggtggaccactatcacaggctctacatgaaggctctggagcaactgtttgaggagcacaagaagagctgcggcctcccggcttctactcacctcaccttcatctag

SEQ ID NO: 44 - DNA, 1872 bp, Danio rerio
acacacagtcgctccaccctcatacagacgtcgcacgagcgaggagcatacattcactcaaactcaagggatatttaaaagatatttcccgacttaatgacattttctagctcaagcaggtattcgcggcgtcttctagtcacccagtcgtgacagcaaagactcgaattctttctctgtttacaaatgattcacgttaaagcaaagcgtcgtttacagggggttcagtcatgcggacgcggattcaaaagtggctggagataaacctcagatagccagtccagaaactacccacatacatttgcaatgacgcgataagacaacgaatcgttatctgtttgaccaattgaaccgatcaaagtgcgagccagacaaatacaagacttcggtcagtgaaggtgaggaagaggattcgtttgccacaggatcactaaacttggccactttaatgggaacagataacgtttcagaggtaaaggagaagggggacaggtcaccatggaaagatataatcgaggatataagtgttttgcaattggtgttgtcatttctttttttaggagtggcttgtctactattgatgatctacctgatgttcacctctctgtggattttccccactctgtacttcacctggcagatctatgattggcacacacctgagagaggtggcagaagaacaaagtttgtgagaggctgggaagtatggaaacacttgcgagactattttcctgtgaagctggtaaagactgctgaattaaatcccaataagaactatattatgggctgtcacccgcacggcatcatgtgttttggagccttctcctgcttcagcacagaccgcaatggatttgcggaaacctttcctggaatacggtccactcttgcaatcttagccggacttttccgccttcctctcttcagggaatacattttagctgcaggattgctgcctgtcagtaaggcaagtttggattatttgctgagccaaactggtgtgggtaacgctgtggtcatcatcattggtggagcagaggaatcactgacctcctctacaggagtaaacactgtggtcataaaacacaggaaaggctttgtacgactggctcttgaacacggggcagacctggttccagtgtactcttttggagagaacgagctgttcccgcaggtggttctgtctgagggcagtgtaggtcgacggctgcaggttctttttaagcagattatgggttttgctccatgcatcttcacaggaggccggtggcttcttctgccgtacaaacttccagtcaccactgtggtgggctgccccataaacgtccctctggtgaaaattccaactcaggaacaggtggatcattaccacggtttatacatggcatctctggctgatcttttccacaagcataagaccagctatggactggcagagacgcacgagctgcacttcatttagcagtgctggaaagcacaaagccatttaaaaagctgactgggatataatgtggggctgatataggaaaaggacaatgcacttatttctgtactgttccatgtgaatgttttaacttcttggttctctgaaatgattcacaaagcacaaaatgaaccaaatgaatacggagatgggcatttgtctgtaacaaaacactcatccttaagaaaggcaaaaggtttgcttacggttatctcagctttgttctgtaaatttgcactgaaatttttacaacatgttagtgtttattataaaggttatacaaagacttttgaagaaaatcatttttaaaaattggtttaatataaatgatttacatatgtattttgttatgtctattcatgtgaaagattataaaaccagcacatttttac

SEQ ID NO: 45 - protein, 334 aa, Homo sapiens
MKVEFAPLNIQLARRLQTVAVLQWVLSFLTGPMSIGITVMLIIHNYLFLYIPYLMWLYFDWHTPERGGRRSSWIKNWTLWKHFKDYFPIHLIKTQDLDPSHNYIFGFHPHGIMAVGAFGNFSVNYSDFKDLFPGFTSYLHVLPLWFWCPVFREYVMSVGLVSVSKKSVSYMVSKEGGGNISVIVLGGAKESLDAHPGKFTLFIRQRKGFVKIALTHGASLVPVVSFGENELFKQTDNPEGSWIRTVQNKLQKIMGFALPLFHARGVFQYNFGLMTYRKAIHTVVGRPIPVRQTLNPTQEQIEELHQTYMEELRKLFEEHKGKYGIPEHETLVLK

SEQ ID NO: 46 - protein, 335 aa, Mus musculus
MMVEFAPLNTPLARCLQTAAVLQWVLSFLLLVQVCIGIMVMLVLYNYWFLYIPYLVWFYYDWRTPEQGGRRWNWVQSWPVWKYFKEYFPICLVKTQDLDPGHNYIFGFHPHGIFVPGAFGNFCTKYSDFKKLFPGFTSYLHVAKIWFCFPLFREYLMSNGPVSVSKESLSHVLSKDGGGNVSIIVLGGAKEALEAHPGTFTLCIRQRKGFVKMALTHGASLVPVFSFGENDLYKQINNPKGSWLRTIQDAMYDSMGVALPLIYARGIFQHYFGIMPYRKLIYTVVGRPIPVQQILNPTSEQIEELHQTYLEELKKLFNEHKGKYGIPEHETLVFK

SEQ ID NO: 47 - protein, 334 aa, Pan troglodytes
MKVEFAPLNIQPARRLQTVAVLQWVLSFLTGPMSIGITVMLIIHSYSFLYIPYLMWLYFDWHTPERGGRRSSWIKNWTLWKHFKDYFPIHLIKTQDLDPSHNYIFGFHPHGIMAVGAFGNFSVNYSDFKDLFPGFTSYLHVLPLWFWCPVFREYVLSVGLVSVSKKSVSYMVSKEGGGNISVIVLGGAKESLDAHPGKFTLFIHQRKGFVKTALTHGASLVPVVSFGENELFKQTDNPEGSWIRTVQNKLQKIMGFALPLFHARGVFQYNFGLMPYRKAIHTVVGRPIPVRQTLNPTQEQIEELHQTYMEELRKLFEEHKGKYGIPEHETLVLK

SEQ ID NO: 48 - protein, 335 aa, Pan troglodytes
MKVEFAPLNIQPARRLQTVAVLQWVLKYLLLGPMSIGITVMLIIHSYSFLYIPYLMWLYFDWHTPERGGRRSSWIKNWTLWKHFKDYFPIHLIKTQDLDPSHNYIFGFHPHGIMAVGAFGNFSVNYSDFKDLFPGFTSYLHVLPLWFWCPVFREYVLSVGLVSVSKKSVSYMVSKEGGGNISVIVLGGAKESLDAHPGKFTLFIHQRKGFVKTALTHGASLVPVVSFGENELFKQTDNPEGSWIRTVQNKLQKIMGFALPLFHARGVFQYNFGLMPYRKAIHTVVGRPIPVRQTLNPTQEQIEELHQTYMEELRKLFEEHKGKYGIPEHETLVLK

SEQ ID NO: 49 - protein, 335 aa, Canis familiaris
MKVEFAPLHIPLARRLQTAAVLQWVLSFLLLAQVCIGIIVVLIVHNYWFLYVPYLTWLCLDWRTPEQGGRRSNWVRSWTVWRYFKDYFPIHLIKTWDLDPSHNYIFGFHPHGVLVAGAFGNFCTNHSDFEELFPGFTAYLHVLPFWFRCPLFREYLMTSGSVSVSKKSVSYVLSKEGGGNISVIVLGGAEESLDAHPGKFTLFIRQRKGFVKVALTHGASLVPVFSFGENELFKQVNNPEGSWLRTVQEKLQKIMGFALPLFHARGIFQYNFGLMPYRKPIHTVVGRPIPVHRTPHPSPGQIEELHQTYMEELRKLFEAHKRKYGIPEHETLIFK

SEQ ID NO: 50 - protein, 335 aa, Bos taurus
MKVEFAPLNIPLARRLQTAAVLHWLLSFLLFAQVCLGIIVFLIIYNYWFLYLPYLTWLYFDWQTPEQGGRRSEWVRNWAIWRYFKDYFPIHLIKTWDLDPSHNYIFGFHPHGVLVVGAFGNFCTNYSAFKELFPGFTSYLHVLPYWFRCPLFREYLMSSGPVSVSKKSVCHVLSKEGGGNISVIVLGGAEESLDAHPGKFTLFIRQRKGFVKIALTHGAYLVPVFSFGENELFKQVSNPEGSWLRNVQEKLQKIMGFALPLFHARGIFQYNFGLIPYRKPIHTVVGRPIPVRQTLNPTSEQIEELHQTYMEELRKLFEEHKGKYGIPENETLIFR

SEQ ID NO: 51 - protein, 183 aa, Rattus norvegicus
MSKEGGGNISVIVIGGAKELLESFPGRYSLCLLQRKGFVKIALTHGAHLVPVFSFGENELYSQVDNPKGSWLRTAQDKVYNLTGLALPLFYARGIFQNSFGLMPYRKLIYTVAAVGTAARLTQKSNHQNDSSVSAEKGNSFICCQVGWCDRDRQPLAAPSLFRRLCTRPQSRLMSCIRRTWRS

SEQ ID NO: 52 - protein, 287 aa, Danio rerio
MLGALYAGWLYLDRDTPSCGGRRSQWVRSWRIWMHFRDYFPITLVKTVDLDPRHNYLLGFHPHGVLVAGGFGNFCTEASGFSQMFPGLTPYLLMLPFWFRVPFFREYIMCGGLVSSEKASASYLLGHPGGGQAAVIAVGGAPESLEARPGALTLQLLQRKGFIKLALKHGAWLVPVFSFGENELFDQMENPAGSALRRMQERLQRIMGVALPLFHARGVFQYSFGLLPYRKPIHTVVGRPIPVSQTPCPSKEDIDALHTLYMQGLTQVFEENKKHYGIADDKHLKFT

SEQ ID NO: 53 - protein, 349 aa, Caenorhabditis elegans
MLDRTESEDKMPHLLGVEWAPLNIPLARRLQTLGALHFFFITLFTPVLVLTVPFYMLYTVLWPLIFLYGLWMIYDWNSPKKGAYMSNWFQRQRIHSWYANYFPVKLHTTSDMPEEHNYLIGYHPHGIISMAAFINFATNGTGILDTLPRIRFHLCTLVGQFWTPWRREWGLLHGMIDCSRESIKHVLEHEKKGKAVVLVVGGAEEALDAHPGCHILTLKKRKGFVKIALQTGAQLVPCYSFGENDIFNQAENPKGSTIRQFQTIMKRVLGFSPPAFYGRGVFNYTFGLLPFRKPINTVLGAPISVTKTVNPTQEQIDTLHQTYMDRLHELFEEHKTKYDVSPTTQLVIN

SEQ ID NO: 54 - protein, 339 aa, Caenorhabditis elegans
MPHLLGVEWAPLNIPLARRLQTLGALHFFFITLFTPVLVLTVPFYMLYTVLWPLIFLYGLWMIYDWNSPKKGAYMSNWFQRQRIHSWYANYFPVKLHTTSDMPEEHNYLIGYHPHGIISMAAFINFATNGTGILDTLPRIRFHLCTLVGQFWTPWRREWGLLHGMIDCSRESIKHVLEHEKKGKAVVLVVGGAEEALDAHPGCHILTLKKRKGFVKIALQTGAQLVPCYSFGENDIFNQAENPKGSTIRQFQTIMKRVLGFSPPAFYGRGVFNYTFGLLPFRKPINTVLGAPISVTKTVNPTQEQIDTLHQTYMDRLHELFEEHKTKYDVSPTTQLVIN

SEQ ID NO: 55 - protein, 340 aa, Caenorhabditis elegans
MPQFLGIEWVDLFSSIQRKKTYLGVVYHFMLTYPLALFVTILPFFLLFTFQWHILALYACWYFYDMDSPRRGGYSSDWVRKWRVNDWFAQYFPINLHKTAELSTDKNYLVGIHPHGIISMAAWSNFATNGTGIYEKFPGIRWNLCTLALQFRMAIRRELLLLTGLIDCSRESIEYVLDKCGQKGRAVVLVIGGAEEALDAHPGYHTLTLASRKGFVREALITGAYLVPVYSFGENDVFEQMENPVGSRLRNFQEWCKSIFGISYPIFHGRGFFQLTFGYLPFRKPIDTVVGAPIPVEKVENPTKEQIDELHTIYCQKLTELFDEHKEKYGVEKDVPLVLR

SEQ ID NO: 56 - protein, 345 aa, Caenorhabditis elegans
MLNYQIHKKLTDIKWVNIFSPWDRQRAYFALVVWFGLIYPFCCLCQVAPFVLFFTGQWIILGLYAVWYLYDRESPRRGGYRDNWFRNLSLHKWFAEYFPVKLHKTAELDPNQNYLFGYHPHGILGVGAWSCFGFDACNVKQVFKGIRFNICTLPGNFTAMFRREILLSIGMIESSKESIEHVLNSEEKGRAVVIVVGGAAEALEAHPGKHTLTLANRKGFVREAVKTGAHLVPVYAFGENDIYKQIDNPEGSKLRKIQEWGKKKMGISLPLIYGRGYFQMALGLLPMSRAVNVVVGAPIQVEKELDPSKEVIDEIHGVYMEKLAELFEEHKAKFGVSKDTRLVFQ

SEQ ID NO: 57 - protein, 359 aa, Caenorhabditis elegans
MRLRLSSISGKAKLPDKEICSSVSRILAPLLVPWKRRLETLAVMGFIFMWVILPIMDLWVPFHVLFNTRWWFLVPLYAVWFYYDFDTPKKASRRWNWARRHVAWKYFASYFPLRLIKTADLPADRNYIIGSHPHGMFSVGGFTAMSTNATGFEDKFPGIKSHIMTLNGQFYFPFRREFGIMLGGIEVSKESLEYTLTKCGKGRACAIVIGGASEALEAHPNKNTLTLINRRGFCKYALKFGADLVPMYNFGENDLYEQYENPKGSRLREVQEKIKDMFGLCPPLLRGRSLFNQYLIGLLPFRKPVTTVMGRPIRVTQTDEPTVEQIDELHAKYCDALYNLFEEYKHLHSIPPDTHLIFQ

SEQ ID NO: 58 - protein, 412 aa, Kluyveromyces lactis
MGKEQIRKRQTKKVRKGSQPVANGKSSVVGVSKDGKPEFCAIDTPIERRLQTLSVAWYVECIPLMIIIMLFVWVNPLMWSFVIPYTIYYFIDRTASNGNAVKRHSKWFRSLKVWFYFRDYFPISMHKSTELEPTFTSIDSTELENDASEPGYLDSSQPVLPDKWWNPFREKDETVRPTGPRYIFGYHPHGIAAFGAFGAFATEACNWSKVFPGIPVCLLTLVNQFQIPVYRDYLLALGITSVARKNAMKVLEKNYSIAIVIGGASESLLTNLGSSDIILSKRKGFVKLALQTGNVSLVPVYGFGETDTYKILKLKNDSIIGRIQIWLKENYSFTVPLFFARGVFNYDFGLLPFRHPVNVVVGNPIHIKEKIDHPTIEEIDHYHSLYIEELKRLYDDNKAKFNYSEKTLNIVE

SEQ ID NO: 59 - protein, 461 aa, Ashbya gossypii
MQDSMDDSLREAEGRQDDSEVSSGTTLGSSTPEDSGVTAKLRKKYQMASALLRRELEELSVYDAKTAGVSGRSSGSGSGGLALLGGRFHVAPLRIPARRRLQTLVVAWHTSSFIYMTVLVLFLAANPLMWWFMVPYMVYYVWNRSPANGGVVRRYSPRLRSLALWRYYCEYYPISLHKSEDLAPTFVPDPRGAEPREWKLRLWLWPTRVELLNLTLQWTRARPQVATGPRYIFGYHPHGVGALGAFGAIATEGCNWSKVFAGIPACLCTLVNQFQIPIYRDYLLGLGCTSVARKNVLKVLEQNYSVCIVVGGAQEALLSRVGSTELVLNKRKGFIKLALETGNVNLVPIYAFGETDCFNVLDTGNESYLRKFQLWIKKTYGFTIPFFFARGVFNYDFGFLPFRNPINVVVGKPVYVDKRRTNPTMEEIDHYHDLYVQELRNVFDKNKHKFGYAGKELKIVE

SEQ ID NO: 60 - protein, 550 aa, Magnaporthe oryzae
MATVDDTQNHVQLNAESSLNEFPYQASADKEEYPSLPSAPLPDVDGSSQNGHTAANADLPPSESTEQPWNKVASGDFIHETKMPSEDRDNLARPGSLPTPEPSRRGSNTLVGSPRQGDGLQMLMDEFADDESSDTSWDIHETIRSRTQALAEKDHQGIFSNQRRGNQADAPDTVTSANAWLPAGFEDDLDEVTGADDEFEPTRGSRWRVRLAPLDTPFHRRMQTLVVLLHVLGMGITFSFFCFLCTLPLFWPIIIAYLVFIRLSRAGSDGKTNRRIEWLRRARIWKYFADYFPVKLHKTADLPPTRKYIFAIHPHGIISHGAFASFATEALGFSEKFPGITNSVCTLHGNFKTPFYREYLMAMGLISVSKESIINTLMTGGINGEGMGRAVSIIVGGAREALEACPKTMRLILKRRGFCRMALRTGADLVPVLCFGENDLYQQWGPQDHPRFRRLQMKALAYLGFAVPVLRGRGVFNYDFGVLPQRRPINVVVGEPIKVEQFRGSGNIEPRVEELWKLYCQKLQELYDQNKHVYFKDRQEDMRFVDSEEL

SEQ ID NO: 61 - protein, 334 aa, Ciona intestinalis
MWEFAPLRIPMIRRLQTLAVSHFVFCFLALAATCTLLTIYITLFTSYWPITTAYLVFLFLDRNTPESGGRRSEWVRNWSLWKWMSDYFPCTLHKTVDLDPKRNYIFGIHPHGVLCIGSFTHFSTNGSGFSHVFPGFTSYLTMLPFWFKMPFFRDYVMSGGLTPATRKAIKHTITRPGGGHICCIIPGGAPESLNARPGDVVLLLKQRLGFLKLAITNGVPLVPVFSFGDHALWEQKPNPPGSLIRRFQDSSQKWMQVALPVFHARGIFQYNFGLIPYRRSVHTVVGEPIEVPQNSNPTSEDLMSLQEDYINRLRAIFDEHKSKYLPEDCKLIIN

SEQ ID NO: 62 - protein, 334 aa, Homo sapiens
MVEFAPLFMPWERRLQTLAVLQFVFSFLALAEICTVGFIALLFTRFWLLTVLYAAWWYLDRDKPRQGGRHIQAIRCWTIWKYMKDYFPISLVKTAELDPSRNYIAGFHPHGVLAVGAFANLCTESTGFSSIFPGIRPHLMMLTLWFRAPFFRDYIMSAGLVTSEKESAAHILNRKGGGNLLGIIVGGAQEALDARPGSFTLLLRNRKGFVRLALTHGAPLVPIFSFGENDLFDQIPNSSGSWLRYIQNRLQKIMGISLPLFHGRGVFQYSFGLIPYRRPITTVVGKPIEVQKTLHPSEEEVNQLHQRYIKELCNLFEAHKLKFNIPADQHLEFC

SEQ ID NO: 63 - protein, 334 aa, Mus musculus
MVEFAPLLVPWERRLQTFAVLQWVFSFLALAQLCIVIFVGLLFTRFWLFSVLYATWWYLDWDKPRQGGRPIQFFRRLAIWKYMKDYFPVSLVKTAELDPSRNYIAGFHPHGVLAAGAFLNLCTESTGFTSLFPGIRSYLMMLTVWFRAPFFRDYIMSGGLVSSEKVSADHILSRKGGGNLLAIIVGGAQEALDARPGAYRLLLKNRKGFIRLALMHGAALVPIFSFGENNLFNQVENTPGTWLRWIQNRLQKIMGISLPLFHGRGVFQYSFGLMPFRQPITTIVGKPIEVQMTPQPSREEVDRLHQRYIKELCKLFEEHKLKFNVPEDQHLEFC

SEQ ID NO: 64 - protein, 334 aa, Pan troglodytes [sequence omitted]

SEQ ID NO: 65 - protein, 334 aa, Canis familiaris
MVKFAPLFVPWERRLQTFMVLQWVFSFLALAQICTVVFVGLLFTRFWVVSVLYAAWWYRDRDTPRQGGRPVQALRRCFLWKYMRDYFPVTLVKTAELDPSRNYLAGFHPHGVLAAGAFVNLCTESTGFPLLFPGIRSHLMMLTLWFRVPFFRDYIMSGGLVTSDKESAAHILSRKEGGNLLAIIVGGAQEALNARPGDSTLLLRNRKGFIRLALMHGAALVPIFSFGENELFDQVENSPGSWLRRIQNRLQKIMGISLPLFHGRGVFQYSFGFIPYRQPITTVVGKPIEVQKTLCPSKEEVDKLHQRYVKELCELFETHKLKYNVPVDQHLEFC

SEQ ID NO: 66 - protein, 332 aa, Bos taurus
MVEFAPLFVPLERRLQTFAVLYWIFCFMVLPPLCLVVFIGLLFTRFWLFNILYVIWLYLDQNRPRQGGSHNKFLKRWVLWKYMKDYFPITLVKTTELDPSRNYLAAFHPHGLLSVGAFTNMCTDSTGFSSLFPGIRPHLTTINIYFRIPLFRDYIMQGGLVSSDKESIAYILSRKGGGNLVAITVGGIREALKTRPGANKLVLRNRKGFIRLALMHGAVLVPIFSFGDNELYAKTSPGFWWKWFRDQLYKKTRLAIPFFYGRGVFQYSFGFMPYRRPITTVVGKPIEVPKIPHPSQEEVDRLHQHYLKELSNLFETHKLKYNIPKDQHLEFC

SEQ ID NO: 67 - protein, 334 aa, Rattus norvegicus
MVEFAPLLVPWERRLQTFAVLQWVFSFLALAQLCIFIFIGLLFTRFWLFSVLYATWWYLDWDRPRQGGRPIQFFRRMAIWKYMKDFFPVSLVKTAELDPSRNYIAGFHPHGVLAAGAFLNLCTESTGFTSLFPGIRSYLMMLTVWFRAPIFRDYIMSGGLVSSEKVSADHILSRKGGGNLLAIIVGGAQEALDARPGAYRLLLKNRKGFIRLALTHGAALVPIFSFGENNLFNQVENTPGTWLRWIQNWLQKIMGISLPLFHGRGVFQYSFGLVPFRQPITTVVGKPIEVQMIPHPSEEEVNRLHQLYIKELCKLFEEHKLKFNVPEDQHLEFC

SEQ ID NO: 68 - protein, 351 aa, Gallus gallus
MERAYKICDDTTSKRLKNLFWAVQNGSPQVSRSSPTTLTAHRLAFLPAQCCTAAFIGLLFTRFWLLSVLYAAWWFVDREAPLRGGRRIHMVRNSAVWRHMRDFFPVTLVKTAELDPRQNYLVGFHPHGVLAVGAFINFGTEATGFSTIFPGITPHLMMLSLWFRVPFLRDYLMSGGLVSSDKESAYHVLQRPEGGNLLAIIVGGAQEALDARPGSCTLLLKNRKGFVRVAIEQGTPLVPAFSFGENELFDQVSNPKGSWLRWIQHRLQQIMGISLPLFHARGIFQYSFGLVPYRRPINTVIGKPIPVLKKHKPTEEEVDRVHKKYLEELSKLFEEHKAKYNVPEDSHLEFI

SEQ ID NO: 69 - protein, 252 aa, Danio rerio
MRDYFPIRLIKTADLDTRKNYVMGFHPHGILVAGAFTNFCTEATGFSKLFPGIKSNLLMLPLWFRAPFFRDYIMSAGLVPSDKESASYLLRRKGGGNAVVIAVGGAPEALDAHPGDYTVHLANKKGFIKLAIEHGADLVPIYSFGENEVFDQVQNPRGTWLRYIQERLQRIMGVSLPLFHARGVFQYTFGLMPYRKPINTVVGRPIPVEKNEKPTAEELDVYHQRYMDELARLFEDHKGNYGVPEDTHLVFQ

SEQ ID NO: 70 - protein, 352 aa, Drosophila melanogaster
MKIEWAPLRVPLERRLQILVTAFFTSMLLILLSVSFLLVAGSLIYGGLLVRSLMVTYLAYVFVHHKKTQSVVDGNGWMITRTNLLHRHYRDYFPVELVKTAELPATKNYILASFPHGILGTGIGINMGLEISKWLELFPQVRPKLGTLDQHFHVPFMREVLRCWGLVSVSKEALIRMLSKSNDPKHKDNRDGFTSNAVAILVGGAQEAMDSHPGQYILTLKNRKGFVRMAIRTGSSIVPSFSFGEVDIFDQVANPPNSLLRRFQDFVKKLTGVSPLIPVGRGFFNYTFGFLPFRRRIVQVVGAPIDVVKNEHPDSEYVDKVHGQVIESLEKLFDQYKDKYLENSKSATLVVH

SEQ ID NO: 71 - protein, 352 aa, Drosophila melanogaster
MKIEWAPKGVPMERRRQTFAMAFLILSFMILSFGSYFFVAAVLFYGSLLWRTIMVIYLVYVYANHKRTHSIMDGNGWKINRNNWLFRHYRDYFPVQLVKTAELPPNKNYILASFPHGILGTGISINMGLDISKWLQLFPQVRPKVATLDQNFLTPIVRGLLRSWGLVSVSKEALVYLLTKSNDPKHKDNRDGFTSNAVAILVGGAQEALDSHPGKYILTLKNRKGFVKMAIRTGSSIVPTFSFGEVDILDQVANPPNSRVRRFQDFVKRITGISPLIPVGRGIFNYSFGFLPNRRRIVQVVGAPIDVVQSDQPDAAYVDKIHKQVIDDLEKMFAKYKDQYIPNSKQDKLIIH

SEQ ID NO: 72 - protein, 349 aa, Drosophila melanogaster
MTIEWAPLRVPLERRLQTLVTSFFTYTFFTLPISSCLAVAILLYYGEMFVRSLLLIYFVKIYLDYKRNYGIMEGNGWLFYRSNWRYRNYFPVELVKTAELPPNRNYIVASFPHGILGTGTCINMSLDIDNWLSLYPHVRPKIATLDHHFKTPFLRDILRWWGMVSVSKESLSYLLSKSNDPMHKDNRDGFTSNAVAVLVGGAKEAMDSHPGQYILTLKDRKGFVKMAVRTGSSIVPSLSFGEVDIFDQVANPPDSSLRRFQNVVKKFTGISPLLPKGRGIFNYNYGILPHRRRIVQVVGSPIDVERCETPDPEYVDKIHGQVIDALARMFDEYKEKYTPNSKHIKLIIQ

SEQ ID NO: 73 - protein, 353 aa, Ashbya gossypii
MGKIEWAPLNVPMRRRIETLSTALWMWLILFGELGMLISYFLLLIYGNLFIKSLCVIYGYFIYTDRKVTLNGGRGQGVTWWRELFWWKLYQSYFPAKLHKTVDLDPNRNYLFAAFPHGVLGLGAFINFATNATGFHDKFPKIRSRPVTLNFHFVIPFFRELLLSWGLVSANPNSILSLLKAPNKPDHPLNDDGYTANAVVIVVGGAAESLHCRPNNYTLVLRKRKGFCKLAIKAGTPLVPVMTFGEVDLFDQPPNPPGSRLRRFQEFVKNTTGIAPAAFVGRGFFQYSYGLIPRRKPLNTVVGAPVEVTQIDNPTQEQVDEVHERFCRALDNLFETNKSRFIADYKNVKLVME

SEQ ID NO: 74 - protein, 353 aa, Drosophila melanogaster; identical to SEQ ID NO: 73

SEQ ID NO: 75 - protein, 338 aa, Tribolium castaneum
MKILGIKFAPLHIPLERRLQTLAAGCWFTTLAFGTFIGTFIWVYVFFTRFWYLSVLYATIIYLEKSKCEKGGRPIEWIRHWGWWYYLKNYFPCKLDFVPGLTFDPKRNYLFACYPHGILPAGPFNTIGSPYSEFSKLFPKFRVRLVILHQHFFIPFLREIAYGTGGISASAKSLNHVLGSPEGGYIAVLMPGGAVEAYNSRPGQYRIILKNRKGFVKLALRNGSPLVPVISFGEPELFDQVEGRTLRKIQESIRKYLGLAPVIFSGRGFFQYSFGVIPQRRPITTVVGHPIEVTKIEKPTNEEVDELHKKYMQELENLFEEYKFKYLENPKDIHLEFE

SEQ ID NO: 76 - protein, 341 aa, Homo sapiens
MGVATTLQPPTTSKTLQKQHLEAVGAYQYVLTFLFMGPFFSLLVFVLLFTSLWPFSVFYLVWLYVDWDTPNQGGRRSEWIRNRAIWRQLRDYYPVKLVKTAELPPDRNYVLGAHPHGIMCTGFLCNFSTESNGFSQLFPGLRPWLAVLAGLFYLPVYRDYIMSFGLCPVSRQSLDFILSQPQLGQAVVIMVGGAHEALYSVPGEHCLTLQKRKGFVRLALRHGASLVPVYSFGENDIFRLKAFATGSWQHWCQLTFKKLMGFSPCIFWGRGLFSATSWGLLPFAVPITTVVGRPIPVPQRLHPTEEEVNHYHALYMTALEQLFEEHKESCGVPASTCLTFI

SEQ ID NO: 77 - protein, 281 aa, Pan troglodytes
MGVATTLLPPTTSKTLQKQHLEAVGAYQYVLTFLFMGPFFSLLVFVLLFTSLWPFSVFYLVWLYVDWDTPNQGGRRSEWIRNWAIWRQLRDYYPVKLVKTAELPPDRNYVLGAHPHGIMCTGFLCNFSTESNGFSQLFPGLRPWLAVLAGLFYLPVYRDYIMSFGLCPVSRQSLDFILSQPQLGQAVVIMVGGAHEALYSVPGEHCLTLQKRKGFVRLALRHGGPPHPCPPAPPPHRGGSQSLSRPLHDGPAAALRGAQGKLWGPRFHLPHLHLGLAAAFR

SEQ ID NO: 78 - protein, 344 aa, Pan troglodytes
MGVATTLLPPTTSKTLQKQHLEAVGAYQYVLTFLFMGPFFSLLVFVLLFTSLWPFSVFYLVWLYVDWDTPNQGGRRSEWIRNWAIWRQLRDYYPVKLVKTAELPPDRNYVLGAHPHGIMCTGFLCNFSTESNGFSQLFPGLRPWLAVLAGLFYLPVYRDYIMSFGLCPVSRQSLDFILSQPQLGQAVVIMVGGAHEALYSVPGEHCLTLQKRKGFVRLALRHGASLVPVYSFGENDIFRLKAFATGSWQHWCQLTFKKFMGFSPCIFWGRGLFSATSWGLLPFAVPITTVGECPPPGGRPPAAAWASGIPRPPVSLSLQWAAPSLSPSASTPPRRKSITITPST

SEQ ID NO: 79 - protein, 341 aa, Pan troglodytes
MGVATTLLPPTTSKTLQKQHLEAVGAYQYVLTFLFMGPFFSLLVFVLLFTSLWPFSVFYLVWLYVDWDTPNQGGRRSEWIRNWAIWRQLRDYYPVKLVKTAELPPDRNYVLGAHPHGIMCTGFLCNFSTESNGFSQLFPGLRPWLAVLAGLFYLPVYRDYIMSFGLCPVSRQSLDFILSQPQLGQAVVIMVGGAHEALYSVPGEHCLTLQKRKGFVRLALRHGASLVPVYSFGENDIFRLKAFATGSWQHWCQLTFKKFMGFSPCIFWGRGLFSATSWGLLPFAVPITTVVGRPIPVPQRLHPTEEEVNHYHALYMMALQQLFEEHKESCGVPASTCLTFI

SEQ ID NO: 80 - protein, 582 aa, Canis familiaris
MTFPDPKTGQCCLSPVLSGPGGGRVALLALGGPLEALEAKPGALFCGSGIRRDLSSWHRDTERALPAVREPSGPLGLLLPFRARPSTRSGSPSLCPLGSPARTSSAALGPARSPRRGGNPALLPTPGHTGSPLLTLPVPDSVETVARGNEEAGRCRGSRSARMARLTRLFRERKARAGLPGHPHLPAVSLRCRHSRGPAHGAGARTRGLPGHAGPRRRGAFGRSSKKAFTPCPNLRRLRSRPWNPTGGGERPTMRTTQKQWLEALSVSYYVFTFLFMGLFFSLLVLFLLFTSFWSISVLYLVWLFLDWDTPNQGGRCFECNRSCTIWKHLKDYFPIKLVKTAELPPDRNYVVGCHPHGIMCMGTFCNFFTEANNFSKQFPGIQTSPVTLAFLLHLPVYRDYLMYLGLCSVNRRSLDFILSKPQPGQAVAIVVGGAHESLFAIPGMHCLVLRNRKGFVRLALRHGASLVPVYSFGENDIFNFKAFPTNSWQYLCQITIKKIMKFSPCIFWGRGLFSADSWGLLPFAKPITTVVGRPIPVPQRLNPTEEEVDHYHMLYMEALEQLFEEHKESCGVPASTHLIFK

SEQ ID NO: 81 - protein, 406 aa, Bos taurus
MISESRLETSGALMRESPHAHSPLQAILGGSQALGHSDQKDFLRSNQSLHPIFPGSEALLAEGEHLGVSTTPPPTPSMKTLKKQWLEVLSTYQYVLCFLFLGPFFSLVGFFLLFTSLWYLSVLYLVWLFLDWDTPQQGGRRNQWLKNCTVWKHLSDYFPIKLVKTVELPPDRNYVLLSHPHGIMGFGTVCNFSTEGTGCSQLFPGLRFSLAVLNCLLYVPGCREYIMSCGTCSVNRQSLDYVLSQPQLGRAVVIMVGGANEALHTVPGEHCLTLRNRKGFVRLALRHGASLVPVYSFGENDVFRVKAFAPDSWQRLFQVTIKRLLSFSPCIFWGRGLFSAKSWGLMPLARPITTVVGRPIPVPQCPQPTEEQVDHYHRLYMKALEQLFEEHKKSCGLPASTHLTFI

SEQ ID NO: 82 - protein, 336 aa, Danio rerio
MGTDNVSEVKEKGDRSPWKDIIEDISVLQLVLSFLFLGVACLLLMIYLMFTSLWIFPTLYFTWQIYDWHTPERGGRRTKFVRGWEVWKHLRDYFPVKLVKTAELNPNKNYIMGCHPHGIMCFGAFSCFSTDRNGFAETFPGIRSTLAILAGLFRLPLFREYILAAGLLPVSKASLDYLLSQTGVGNAVVIIIGGAEESLTSSTGVNTVVIKHRKGFVRLALEHGADLVPVYSFGENELFPQVVLSEGSVGRRLQVLFKQIMGFAPCIFTGGRWLLLPYKLPVTTVVGCPINVPLVKIPTQEQVDHYHGLYMASLADLFHKHKTSYGLAETHELHFI

SEQ ID NO: 83 - protein, 520 aa, Arabidopsis thaliana
MAILDSAGVTTVTENGGGEFVDLDRLRRRKSRSDSSNGLLLSGSDNNSPSDDVGAPADVRDRIDSVVNDDAQGTANLAGDNNGGGDNNGGGRGGGEGRGNADATFTYRPSVPAHRRARESPLSSDAIFKQSHAGLFNLCVVVLIAVNSRLIIENLMKYGWLIRTDFWFSSRSLRDWPLFMCCISLSIFPLAAFTVEKLVLQKYISEPVVIFLHIIITMTEVLYPVYVTLRCDSAFLSGVTLMLLTCIVWLKLVSYAHTSYDIRSLANAADKANPEVSYYVSLKSLAYFMVAPTLCYQPSYPRSACIRKGWVARQFAKLVIFTGFMGFIIEQYINPIVRNSKHPLKGDLLYAIERVLKLSVPNLYVWLCMFYCFFHLWLNILAELLCFGDREFYKDWWNAKSVGDYWRMWNMPVHKWMVRHIYFPCLRSKIPKTLAIIIAFLVSAVFHELCIAVPCRLFKLWAFLGIMFQVPLVFITNYLQERFGSTVGNMIFWFIFCIFGQPMCVLLYYHDLMNRKGSMS

SEQ ID NO: 84 - DNA, 1856 bp, Arabidopsis thaliana
aaggaccttccctctctttctttccaaatctctctttatctctctttctctgtttactaaatcgccagtattcgccgcaagaaagatgtctccggcgaagaagagccgaagttttcctccgataagcgagtgtaaaagcagagagtatgattcgatcgctgcggatctcgacgggactctgcttctgtcaagaagctctttcccttacttcatgctggtggccattgaagcaggtagtctcttccgtggattgatccttcttctttctcttcccatcgtcatcatcgcttatctcttcgtctccgaatctctcggaatccaaatccttatcttcatctccttcgccggtatcaagatcaagaacatcgaactcgtctctcgcgccgttcttacacggttttacgcggcggatgtgaggaaagatagttttgaggtgtttgataaatgtaagaagaggaaagtagtggtgactgcgaatccgatagtgatggttgagccattcgtcaaagactatttgggaggagataaagttttgggaacagagattgaagttaaccccaaaacgatgaaagctactggttttgtgaaaaagcctggtgttcttgttggtgatctcaagagattagccatcttgaaagagttcggcgatgactcaccggatcttggcctcggtgaccgcacctccgatcacgatttcatgtccatttgcaaggaaggttacatggtgcatgagaccaaatcagccacaacagtccctatagagagtctcaagaaccgcataatcttccatgatggccgtcttgtccaacgtccgaccccattaaacgccttaatcatttacctttggcttcctttcggcttcatgctctctgtcttccgcgtctacttcaacctccctttacccgaacgcttcgtccgctacacttacgagatcctcggcattcacctcacaatccgtggccaccgtcctccacctccttcccccggaaaacctggaaacctctacgttctcaaccaccgcaccgcccttgaccccattatcatcgccattgctctcggccgtaagatcacatgtgtcacttatagtgtctctcgcctctccctgatgctctcacccattcctgctgttgctctgacccgagaccgtgtcgctgacgcagcccgcatgaggcaactcctcgagaaaggtgatttggtgatctgtcctgaaggcacaacgtgtagagaaccatatctactaaggttcagtgctctatttgcagagctgagcgaccggatcgtgcctgtggccatgaactgcaagcaagggatgttcaacgggacgacagttagaggtgtgaaattctgggatccgtacttcttcttcatgaacccccgacctagctacgaggccactttcttggaccgtttgcccgaagaaatgacggtaaacggtggtggcaagactccttttgaggtggctaattacgttcagaaggtgatcggtggagttttggggttcgaatgtactgaacttacaaggaaggataagtatctgttgcttggaggcaacgacggaaaggttgagtctatcaataagaccaagtccatggagtaataatccagctagtctggttgctgctattttgcttgggagtgaagttaggtctttcgggttttcccaattacttttttttttgttttttttcatgtattgttcgaggaaaatgttttgttgaatatgcactggataatgaaactacatttgaatcaaagtacgtacatgtagtgtaccatttccccttgccttaactatgaatgatttgtaaactcaccttgtattataagatatcatagagaaaaacacattctcgact

SEQ ID NO: 85 - DNA, 1845 bp, Arabidopsis thaliana
atatccattctcaccttccaaatctccccactctctctctctctctctctctctctctctctctctctctctctatctctctctatctctctctatcttctcttttctcctctctccaacttcttcactaatgggagctcaggagaaacggcgccgtttcgagcagatatcaaagtgcgatgttaaggaccggtccaaccataccgtggccgctgatctagacggaacactactaatctctcgtagcgccttcccttactatttcctcgtagccctcgaggcagggagcttgctccgagcgttgatcctacttgtgtccgtaccattcgtttatcttacgtacttgaccatctccgagactttagccatcaacgtatttgtcttcatcacgttcgcgggtctcaagatccgagacgttgagctagtggtccgttccgtcctcccgaggttctatgcggaggacgtgaggcccgatacctggcgtatcttcaacacgttcgggaaacggtacataataactgcgagccctcgaattatggtcgagccattcgtgaaaacattcctaggagttgataaagttcttggaacagagctagaggtctccaaatcgggtcgggcaaccgggttcaccagaaaaccaggtattctcgtcggtcagtacaaacgtgacgtcgttttgagagagtttggtggcctagcgtctgatttacctgatttggggctcggcgatagcaagacggaccacgacttcatgtccatctgcaaggaaggttacatggtgccacgtacgaaatgcgaaccattaccaagaaacaaactcttaagccccataatattccacgagggcagattagtccaacgcccaacgccgttagttgctctgttaactttcctctggcttcccgtcggtttcgtcctctctatcatccgcgtctacacgaatattccgttaccggaacgtatcgcccgttacaactacaagcttactggcatcaagctagtcgtcaacggccaccctcctccgccgccaaaacctggccagccaggccatcttttggtctgcaaccaccgcaccgttctcgatcctgtggtcacagctgtcgcactcggccggaaaatcagctgcgtcacttacagcatcagcaagttctctgagctaatctcaccaatcaaagccgttgcgttgactcgtcaacgtgagaaagacgcagcgaacatcaagcgtcttttggaggaaggcgatctcgtgatatgtcccgagggaaccacgtgccgtgagcctttccttctccggtttagtgctcttttcgctgagctcacggaccggatcgttcccgtggcgatcaacacaaagcagagcatgttcaatggtaccaccacacgtggatacaagcttcttgatccttactttgcgttcatgaacccgaggccgacgtatgagatcacgttcctcaaacagattccagctgagctgacgtgtaaaggaggcaaatctccgatagaggttgcgaattacatacagagggttttgggaggaaccttaggttttgagtgcaccaatttcacaagaaaggataagtacgcaatgcttgctggtactgacggtagggttccggtgaagaaggagaagacgtgattattgatcggaggatggagaaaacaaagaaataatacaaagattggaatctttttcatttggatggttaattatcaatacttaaggggcaaagaattgataagtttgtttttgttgttacctttatcttctctgcttcggtgaatgtttcttcaagttttacatttagtacaataacggtttaagaaaagaaagaaaaaagtatcggt

SEQ ID NO: 86 - DNA, 1216 bp, Arabidopsis thaliana
tcacttcttggtgttgttgatagactccaccttgccgtcattacctccaagcaaaagatatttatccttgcgagtaagttcggtgcattcgaagcccaaaaccgcgccgataactttctggacgtaattagccacctctataggagtcttgccaccaccgttgacagtcatttcttcaggcaaacgatccaagaaagtggcttcatagcttggtcttgggttcatgaagaagaagtaagggtcccaaaacttcacacccctaactgtggtcccgttgaacattccttgtttacagttcatcgctactggcacaatccggtcgcttagctctgcgaatagagcgctaaatctcagtagatactcttctctacacgtcgtgccttccggacatatcaccaagtcgcctgttatacaccaaaaacatatcattagctcaacaactccattgatttttaatttctcaactaaagattaatgtgaatgtaagtcaatattcaaaagaagtaaacaatattattttatgttcatttatataaatttggttagaagatgcgttaattaggtaccaaagtaaacatcaaagaccataccaaagtaatatttactatattgagatttgcatgggctactatatatgtattcatcgaaaaataaaaagaaagaaatagaaactcctattgaaccccctggacagtgaaacttgttataggtatgctctagtaatatatgatgagaagatgtgtaaagtacctttctcgagaagttttctcatgttggcagcatcggtggcacggtcacgggtgagggcaacagcaggaataggagaaagcataagggagagacgagagacactgtaagtgacgcaacagatcttacgtccaagagcaatagcaacgatgatgggatcaagcgcggtacggtggttaaggacatagaggttgccaagagttccaggggaaggaggtggaggacgatgaccacgaatggttaagtggatcccgagcatctcgtaagtgtaacggacaaatctttcaggtaaagggaggttgaagtagacgcgaatgatggagaggatgaaaccaaaaggaagccataggtatgtgataatggcgtttaacggagttggacgttgcgctaaacgcccatcatggaagactatgcggttctttaagcgttcttttggaatcgttgtggctgacttggtcgcatgaaccat

SEQ ID NO: 87 - DNA, 1736 bp, Arabidopsis thaliana
atctctctttctctgtttactaaatcgccagtattcgccgcaagaaagatgtctccggcgaagaagagccgaagttttcctccgataagcgagtgtaaaagcagagagtatgattcgatcgctgcggatctcgacgggactctgcttctgtcaagaagctctttcccttacttcatgctggtggccattgaagcaggtagtctcttccgtggattgatccttcttctttctcttcccatcgtcatcatcgcttatctcttcgtctccgaatctctcggaatccaaatccttatcttcatctccttcgccggtatcaagatcaagaacatcgaactcgtctctcgcgccgttcttacacggttttacgcggcggatgtgaggaaagatagttttgaggtgtttgataaatgtaagaagaggaaagtagtggtgactgcgaatccgatagtgatggttgagccattcgtcaaagactatttgggaggagataaagttttgggaacagagattgaagttaaccccaaaacgatgaaagctactggttttgtgaaaaagcctggtgttcttgttggtgatctcaagagattagccatcttgaaagagttcggcgatgactcaccggatcttggcctcggtgaccgcacctccgatcacgatttcaagtccatttgcaaggaaggttacatggtgcatgagaccaaatcagccacaacagtccctatagagagtctcaagaaccgcataatcttccatgatggccgtcttgtccaacgtccgaccccattaaacgccttaatcatttacctttggcttcctttcggcttcatgctctctgtcttccgcgtctacttcaacctccctttacccgaacgcttcgtccgctacacttacgagatcctcggcattcacctcacaatccgtggccaccgtcctccacctccttcccccggaaaacctggaaacctctacgttctcaaccaccgcaccgcccttgaccccattatcatcgccattgctctcggccgtaagatcacatgtgtcacttatagtgtctctcgcctctccctgatgctctcacccattcctgctgttgctctgacccgagaccgtgtcgctgacgcagcccgcatgaggcaactcctcgagaaaggtgatttggtgatctgtcctgaaggcacaacgtgtagagaaccatatctactaaggttcagtgctctatttgcagagctgagcgaccggatcgtgcctgtggccatgaactgcaagcaagggatgttcaacgggacgacagttagaggtgtgaaattctgggatccgtacttcttcttcatgaacccccgacctagctacgaggccactttcttggaccgtttgcccgaagaaatgacggtaaacggtggtggcaagactccttttgaggtggctaattacgttcagaaggtgatcggtggagttttggggttcgaatgtactgaacttacaaggaaggataagtatctgttgcttggaggcaacgacggaaaggttgagtctatcaataagaccaagtccatggagtaataatccagctagtctggttgctgctattttgcttgggagtgaagttaggtctttcgggttttcccaattacttttttttttgttttttttcatgtattgttcgaggaaaatgttttgttgaatatgcactggataatgaaactacatttgaatcaaagtacgtacatgtagtgtac

SEQ ID NO: 88 - DNA, 1817 bp, Oryza sativa
ttaacatcccatggccttcttctcgtcgatgttgggcttggacacgacggtgccgtcgttgccggcgagcgccctgtacttgtccttcctggtgaagctggtgcactcgtaggagagcgtggaggcgatgagcctctggatgtagttggccacctcgtggctgctccggccgccgccgccgccgccaccgccgttgcaggtgagctcgccggggagcttgctgaggaaggtgaccacgtatccggggctagggttcatgaagaagtagaaggggtccagcgccttccaccccctcgccgtcgtgccgtggaacatgctcatctggttctccatcgccaccggcacgatctcgtcggtgagctccgcgaacagcgccgagaaccggaggaggaacggctcccggcacgtcgtcccctccgggcagatcaccaggtcgccctccgccagcagccgccggatcatcgccgcgtccgccgccctgtcccgcgtcagccgcaccgtcctgatcggcgacaatatctccgacagccgcgacacctgttcagacacgcaccaagatttttatttttaaaattttgaacaacttaaattttaaaatttaaaaataaacctttctaagatttattatcaacatctaaacttttttgaccatgttagccgagttggcatcatacaggtctggctagcctaacagcgttgtcctgccacaccaccctaggtaacgtagcagaacaaaactgtcacgcttgacacgacagtgtcattttgccatgttagacacaggctggcgtgattaaaatgttcaactttctaaaataagctatagaatagtttgtttttaatataaaaaaagaaaaattcaaaagttaatataaattccatgcaccggcgagttagctggtgagctagctgctcgccggagttggtggtggtgtgatcatgtgtactaccgagtaggtgacggcggtgatggggcggccgagggcggtggagaggaagatggggtcgaggagggtgcggtgggagcagatgaagagcacgccggactggccggtctcgcggctggccggtggcggcggggtgcccttgacggtgacgcgcacgccgagggcgcggaaggcgtggtacaccacgcgcatcgggaggagcgcgccggcggcgatgcggaggcaggcgagcacgaagccgatggggatccagagcacggtgagcagcgcgagcgccggcgacggcttctggaccaggcggccgtcgtggaacaccaccggcttcgggagctcctcccgcggcacgggcctcggcgtcggcgacaccggcaccacgtacccctccttgcatagcctcatgaacgggtagtccgtcctccggtcgccgatgccgatctccggcgaggcgtcgccgaacgcctcccggagcgcggccgccttgttctcgccgacgagcacgccggggctccggacgagccccgtggcgcggccacgccagaccacgagctccgtgcccacgacgatgtcggcgccgaggtactccttcaagaacgcctccaccatcatcctcgggttcgcggtgagcacgcaccggcgcccgcacgccgagaacacgcgccacgactccgggtggatgtcggagcagtagaacttgggcagcacggcgcgcgccaccgcctcaacgtcggcgaccctcgcgccggccatggacgcgaagatgagcacctggatgccggccgactcggacaccaggtagtagagcacgccggcgagcggcgccagcaggatcagcgccagcagccggaggacgccccccgtctcgaacgccat

SEQ ID NO: 89 - DNA, 1924 bp, Picea sitchensis
ccccccggtacgttttgtttgagaaggaatatggcgaagggccagagtggcctcgactgtcaagggctctttgatgtgattagcaaatgcagctccaagggccgagaaaatcagaccgtggctgcggatcttgatggcaccatgctcagatccaggagctcgttcccttatttcatgctcgtggccatggagggcgggagcctgttacgcggcatggtgctcctcgcctgcgctcccatggcctggtttctctacaacttcatctccgaagctgcggggattcagcttctcatctttatttccttcgctggactcaagatccgggatatcgagctcgtttcccgcgccgtgttgcccaagttctatgccgaggacgtgcacccggagtcatggagggtcttcagcgcctttgggaagcggtacatcgtgactgcgaatccaagaatcatggtggagcccttcgtgaagggctatttgggggctgacaaggttcttggaacggagctgcaggtttccaggagcgggcgggctaccgggttcgtgaagaagcctggtgtgctcgttggggatttgaagaaggcagctgtggaagcggaattcggtgataaattgcctgagcttggccttggggatcgagagacagatcatcctttcatgtccctctgcaaggaggggtacatggtgcccaagatgaaggtggacgaagtgcccacaaacaaactaatgagcccaatcgtcttccacgacgggcgtttggtgcagagaccgaaccccggggccgcccttctcacctttctatggctgcccataggcttctttttggctcagtttcgagtcttcggcaacattcccatcccagagaaatacgtgaaaatctcctacaagataatgggaatcaagctggtcgtcaagggaacgcctccgccggccccgaagaagaaaggcgagcggggcgtgctgttcgtatgcgatcacagaacgttgctggatcccgtgatcgtggccgtggccctgggaaggaaagttagcgccgtcacgtacagcatcagtcggttctcggagattatctcgcccattaaaaccgtccggctcactcgggaccgcgagagggacgccgctaacatcaagcgcctgctggaggagggcgacctggtgatctgcccggagggcaccacgtgcagggagcccttcctcctgaggttcagtgctctattcgcggagctcacggacaggatagtgcccgtggccatctgcaacaagatgagcatgttccacggaacaacggtgcgcgggtggaagggcttcgatccttttttctttttcatgaatccggtgcccacctacgaggtaacgttcttggatcagttgcctacggagctcacgtgcgccggaggcaaatctcccatcgaagtcgctaattacattcagagggtgctggcggccactcttggctacgagtgcaccaatttcaccaggaaggacaagtaccggatgctcgcaggcaacgatggcattgtttcccttaataagactgctactgcccgcagcaacaaccacaaacagaattgatccaccgaattccaccgaattccaggccgggtattcttaatcatgataaattttaataatctcttattaatctatgattccaattattacatactgcaaatttgaacgcgtagttaagcagaatcttcccacgaatgaatgtatacacctcataattggtatatctgtattgcaaattagatcagatcgtagttaaagaagaatcccactaatggttgcgccataattggcacatctggtcattatattgcaaattattccagtaatttgcctggactgtattatgctcaaggatcagaaataatataatgcccaaggatttttttgtccaaaaacaagaaaaaaaaaaaaaaaa

SEQ ID NO: 90 - DNA, 1765 bp, Zea mays
cgcacgcagcagtacgacgtctctcctctgggtctggggccgagacaccgagcacgtactaccagcaagatggtggcgtctcccagattcaagcccatcgaggagtgctgctcggaggggcggtcggagcagacggtggccgccgacctggacggcacgctgctcatctccaggagcgcgttcccctactacctcctcgtggctctcgaggccggcagcgtcctccgcgccgcgctgctgctcctgtccgtgccgttcgtctacgtcacctacgccttcttctccgagtcgctggccatcagcacgctggtgtacatctccgtggcggggctcaaggtgcgcagcatcgagatggtggcgcgctccgtgctccccaggttctacgcgggcgacgtgcacccggagagctggagggtgttcagctccttcggcaggcgctacgtcgtcacggccagccccagggtcatggtcgagcccttcgccagggccttcctcggcgccgacaaggtcgtcgggaccgagctggaggtcggcagggacggcaaggccacgggcttcatggccaggccaggcgtgctcgtcggcgaccacaagaagaaggccgtcgtcaaggagctcggcgacgcgctgcccgacgtcggcatgggggatagggagaccgacttcgacttcatgtccatctgcaaggaggcctacctggtgacgtcaaggaagtacagcccggtgcccaggaaccagctgctgagcccgctgatcgtgcacgacggccgcctcgtgcagcgcccgacgccgctcgtcgcgctcgtcaccttcctctggatgccgttcggcttcgcgctggcgctcatgcgcgtgtacatcaacctgccgctgcccgagcgcatcgtctactacacctacaagctcatgggcatcaggctcgtcgtcaagggcaccccgccgccgccgcccaagaagggccacccgggcgtcctcttcgtctgcaaccaccgcaccgtgctcgaccccgtcgaggtggccgtggcgctgcgccgcaaggtcagctgcgtcacctacagcatctccaagttctccgagctcatctcgcccatcaaggccgtcgcgctgtcgcgggagcgcgacaaggacgccgagaacatccgccgcctgctggaggagggcgacctggtcatctgccccgagggcaccacctgccgcgagcccttcctgctgcgcttcagcgcgctcttcgccgagctcaccgaccgcatcgtgcccgtggccatcaacaccaaggagaccatgttccacggctccaccgtgcgcggcttcaagctcatggatccctacttcttcttcatgaacccgcgcccgacgtacgagatcacgttcctcacccagctccccaaagacctcacgtgcagcggcggcaagtcgcccatcgaggtggccaactatatccagaagacgctcagcggacagcttggcttcgagtgcacgtccatcacgcgcaaggagaagtacggcatgctcgctggcaccgacggccgtgtcccgtccaagaacaaggagaaggagaaggagaaggataagaactaacggccaacgtcgctctcttgctgctgcccagcagactgccgtttaattactgctcaaatttattccaatttattgttccttgtcgacaagttggccagtgtgatgtgggccgtgtactagtacaagcttgatgatgattagtatatctacaattcttcctttccggaagaagggcggaagagttgtt

SEQ ID NO: 91 - DNA, 1778 bp, Arabidopsis thaliana
agagacacacacacagcgagtgaaaatgtctccggagaagaagagtcaaaacttccctccaataacggaatgcagagacggagagtacgattcgatagccgccgatcttgacgggactctgcttctctcaagaagctccttcccttacttcatgctcgtcgctgttgaagctggaagccttttacgtggactaatcctccttctctcgttaccattcgtcattatctcttacctattcgtatccgaatctcttggtatccagatcctcatcttcatctcattcgctggtctcaaaatccgcgatatcgaacttgtctctcgcgcagttcttccacggttttacgcggcggatgtgaggaaagacagttttgaggtgtttgataagtgtaagagaaaagtggtagtgacggcgaatccgattgtgatggtggaggcgtttgtgaaggattatcttggaggtgataaagttttgggaacagagattgaagttaaccctaaaaccaatagagccactggatttgtgaagaagcctggtgttcttgttggtgatcttaagaggttagccattttaaaagagtttggtaacgaatcacctgatctcggcctcggtgatcgaacctctgatcatgatttcatgtctctctgcaagaaaggttacatggttcatgcgaccaagtcagccacaacgattccaaaagaacgcttaaagaaccgcatagtcttccatgatgggcgtttagcgcaacgtccaactccgttaaacgccattatcacatacctatggcttccttttggtttcatcctctccatcattcgcgtctacttcaacctccctttacctgaaagatttgtccgttacacttacgagatgctcgggatccacttaaccattcgtggtcatcgtcctccacctccttcccctggaactcttggcaacctctatgtccttaaccaccgtaccgcgcttgatcccatcatcgttgctattgctcttggacgtaagatctgttgcgtcacttacagtgtctctcgtctctcccttatgctttctcctattcctgctgttgccctcacccgtgaccgtgccaccgatgctgccaacatgagaaaacttctcgagaaaggcgacttggtgatatgtccggaaggcacgacgtgtagagaagagtatctactgagatctagcgctctattcgcagagctaagcgaccggattgtgccagtagcgatgaactgtaaacaaggaatgttcaacgggaccacagttaggggtgtgaagttttgggacccttacttcttcttcatgaacccaagaccaagctatgaagccactttcttggatcgtttgcctgaagaaatgactgtcaacggtggtggcaagactcctatagaggtggctaattacgtccagaaagttatcggcgcggttttgggcttcgaatgcaccgaacttactcgcaaggataaatatcttttgcttggaggtaatgacggcaaggtggagtctatcaacaacaccaagaagtgaatatcttattcttgttataacttggcattgacttattgcaagtaaggttggatcatatacgaattttcatgtgtgtaattgcttgagctcttgtcatcattatggtacgttattgttatgtttattctattttgttcttaatgtcgaacgggtaactatatccttaaaaactattttgtgatcccgtttctatacggatgtgtatagagactttctatttaaagtgcaaaattttattggagaaaaaaaa

SEQ ID NO: 92 - DNA, 1832 bp, Oryza sativa
ggctagctgctccgtgtctccctcgttgcatggtaagctagcatgtcgccgttcaagccgatcgagcagtgctcgacggaggggcggtcgcagcagacggtggcctccgacctcgacggcacgctgctcctgtcccgcagcgccttcccgtactacctcctcgtcgcgctcgaggccggcggccccctccgcgcggtcgcgctgctcatgtccgtgcccttcgtctacctcacgtacgtcaccatctccgagtccctcgccgtgcgcgcgctgctgtacatcgccgtggcgggtctcgaggtgagggacgtcgagtcggtggcgcggtcggtgctgcccaggttctacgccggcgacgtccacccggaggggtggcgggtgttcagctcgttcggcaggaggtgcgtcgtgacggcgagccccagggtgatggtggagccgttcgcgagggcgttcctcggcgcggacagggtcatcggcacggagctggaggtcggcgaggacggcagggccaccggcttcgtcgccaagcccggcgtgctcatccgcgagcacaagaggaacgcggtggtgagggagttcggcgacgcgctgccggacgtcggcatgggggacagggagagcgacttcgacttcatggccatctgcaaggacgcgtacgtcgtgaccacctcgcggaagcaccggccggtgccggagagccagctgctgagaaccgtcgtcctccacgacggccgcctcgcccagcgcccgacggcgatcaacacgctgctcgtcttcctctggatgccggtcggcttcgcgctcgcgctcctccgcgcgtgcctcagcctgctcctccccgagcgcgtcctctcctacgcctacaagctcacgggcgtcgggctcgtggtgcgcggccgcccgccgccgccggacgggagccccggcgtgctcttcgtgtgcaaccaccgcaccgtgctcgaccaggtcgccgtcgccgccgcgctgggccgcaaggtgatctgcgtcacgtacagcgtccctcggaaaacgtacggcatgagctccaggctcccggaggcgctcacggcctcgccggtcaaggccgccgtcgcgctgtgcagggagcgcgacagggacgcggaccgtgtccggcggctgctggaggagggcgtcgacatcgtcgccttccccgagggcaccacctgccgaggggcgttcctgctgcggttcagctcgctgttcgccgagctcaccgaccgcatcgtgccggtggccatcgccaccagggagaccatgttccacggctccacggcgcgcgggtttaagggcatggacccttacttcttcttcatgaacccgcggccggcgtacgaggtcacgttcctgagccagctgccgagtgagctcacctccggcggcggcggcaagtcgccggtcgaggtggccaactacgtgcagaaggcgctcgccgggcagctggggtccgagcacatcggcatcacgcgcaaggagaagtagcgaatgcttgccggcaccgacggccgtgtggagtcgaatgaggactagaaccagaagccacacgcccactattattggttccaatatatatggccaggagcctcgtttcttcgttatttctgtcacataacaagcttcaagtgcttatacgagaactgaagatgcaacatagtagaactcatgttgttcgttgtggacttgtggtataacgactttgatcatttctttgtccttttatttttacaaaaatccaagaaatatagtcatataagtttcatactgatgtaaattcttttgctatataatagatttggctatgtttttttttc

SEQ ID NO: 93 - DNA, 2529 bp, Oryza sativa
tcaattggccttgggcttgtcggcggcggcggcgacccggccgtcgttgccggcgagcttcatgtacttgtccttcctggtgagcgtggtgcattggaaccctagctccttggcgatcaccctctgcacgtggttcgccacctccaccgcgctcctcccgccggcgacgcacgtctcctccggcctcagcgccggcaggaacgtcacctcgtaccccggccgcgggttcatgtagaagaagtaagggtccaggaacttccaccccctcgccgtcgacccatagtacgtcccctgcctcgcctccaccgccaccggcacgatcctcgccgtcagctccgcgaacagcgccgagaaccgcagcaggtacggctcccggcacgtcgtcccctccgggcacaccaccacgtccccctcctccagcagcgccgcgatgcgcgccgcgtccgccgcgcggtccggcgtcagcgccgccgcgcggatcggcgagatcgccgtcgacagccggctaacgctgtacgtcacgcacgtcacggggcggcccagcgcgatggacacgatgatggggtccagcgcggtgcggtggttgcacaccaggagggagcccggcgtccccgggcgcggcggcggcggcggcgccccgcgcacggcgaggcggatgccggtgaggcggtaggtgtggcggacgaggcgcgccgggacggggaggttgaggaacacgcggaggagcgccacggcgaagcccacggggaggtaggccagcgcgaacagcgcgctcgctggctccgggcggcggacgaggcggccgtcgtggaagatggcgcgcgacagcagctcgtcggcggcggcgcgcggcgcgcgcttgttcttgggcaccatgtaggcttcctgcgcattagcaatttggcgccaaaacagagttagcacactaaggctgtgtttagtttcacatcaaaattgaaagtttggagaaattagaacggtgtaacagaaaagttggaagtttgtgtgtgtagaaaaattcgatgtgacagaaaagttaaaagtttaaagaaaaaagttaaatctaaacaaggcctaatttttacaaatatctggctttggagtatattcatatgtacattttgaacagttgtcttctttttttttgttaaataaaaacaaatattgatgatggactaggttgcattctgaatgtaagcatgaaattttagtttatgatagtctaaccaattaaaaattgctagtggtcaaagttgaaacagtagagtcaatattcagagtaaatgcaaatggagagagtactaaatccacattaattgatgcaaagaaaacaatactatatgagtaaagtgatcaatgataatgatattactataacaagtcagcatgagcaaacaatatttgaatataggagtacatactaatttggggttttggttttaaaaaggacgaaataaataggaagcaactgctaactgcctactaaaggaggtgatggtaccaacagtattgagttttggccacaagttttgcataaccataatgtaaattctagagccttcttgatctttcctatgaaaagaggggaaaaaaaaggcaattcaacaaaaagaaaaggcaaaaagctaagaagcgtacatattcttgctactcgtgctaccacaaatgagccaatcggatcgaagccatgaacactcgaagaacaatcgagcgtgcaattcctaccacaattaatttcacaatattttctttttttatttttggcgttctaaatgaattgttaaattattagtggccacatgatgcaaaacttcaattttgttcatgtgtgattgattcaattcaagaaatgatgaaaatttcgagctttggatcgtaggccatgaagtgtaccttgcagatggccatgaagtcgtggtcgctctcgcggtcgccgaggccgacgtcgggcatgtcgccgccggcgaagagcctctcgacgacctcgcgcttcttctcgccgacgaggacggccttgatgcggccggtgaaccgcttgccggaggcgaacgtctcgagctcggtgccggccacctcggcgccgaggaactcgcgcacgaactcccccaccatgacggccggcgacgcggtgaccacgacgcggcgctcggcgcagccgtggaacaccgcccacgtgtcggcgcgcaccccggcggcgtagtggcgcggcagcacggcgcgcgccacggcctcgacgtcgcggacgcgcagcccggcgaacgtgatgaacacgagcagggcgatggcggcggcctcggagacgccgacgtagagcgcgaggagccacggcgcggcgagcagcagcgccagcgcgcggaggtagctgccggcctcgagagccacgaggaagtagtacgggaacgccgacgacgacaccagcagcgtcccgtcgaggtccgccgccaccgtccgcctcgcgcccgccgccgcgtcgtacgccgtcaccggcggaaagaacctcctcctccccgccgccgccgccgccgccat

SEQ ID NO: 94 - DNA, 3320 bp, Oryza sativa
atgtcgccgttcaagccgatcaagcagtgctcgacggaggggcggtcgcagcagacggtggcctccgacctcgacggcacgctgctcctgtcccgcagcgccttcccgtactacctcctcgtcgcgctcgaggccggcggccccctccgcgcggtcgcgctgctcatgtccgtgcccttcgtctacctcacgtacgtcaccatctccgagtccctcgccgtgcgcgcgctgctgtacatcgccgtggcgggtctcgaggtgagggacgtcgagtcggtggcgcggtcggtgctgcccaggttctacgccggcgacgtccacccggaggggtggcgggtgttcagctcgttcggcaggaggtgcgtcgtgacggcgagccccagggtgatggtggagccgttcgcgagggcgttcctcggcgcggacagggtcatcggcacggagctggaggtcggcgaggacggcagggccaccggcttcgtcgccaagcccggcgtgctcatccgcgagcacaagaggaacgcggtggtgagggagttcggcgacgcgctgccggacgtcggcatgggggacagggagagcgacttcgacttcatggccatctgcaaggtacggacaaagaatattgcctattcccttaactacttactactacctaagttccaaaaatagtttgcttttacacatggacaactgcctgtctaaatgtagaaaaatgagttcttttttaaaaagtagaggtaggattgtactagcacacatgttcatattacgtgtgtcctagtatttggtacagtacatttataacggcaagtagcttatagtgcaacctgcaggcagcatatctgcatatggaattttgcgatgtggccgcccaattatgtacttagtattttttttaaaagagatgtacttagtatttcgcatacaattttgctatatatttgacgacaaattttaccacaaaaatttgacagatataattacagtacaatcgtagtgtaattacactgtaacttgcatgtaattacactgtaactatagtgtaacttgtatgtaattttcaaaaatatctccgtaacatgttatttcgataaaatgaggttgtgggaataaattctttcatatatgtgtgctatgatttgttttcttcctcaccaaaacaaatcttgtaatagatctaacgattcaaaattatgtgaaacttacatataagttacactgtagttacatgcaagttacagtgtaattacatataagttacagtgtaattacactaccactgtactataattacatctgtcaaatttttaggagaaaatttgtcgacaaatgtataggtggtccctttggcatatataagtaggttaattgcaacagtacaaacaatatattattaattccttgtactatgtaatacactgaatagtacaacgagtatgcattttgttcgttgccatttatgctgaggataattgtagtatggcattaatcgatctggaccaatctctccacgttaggtgtctgcattcaccggtgagatgatcagttgagaggtagttgtgccattgatatcgtccactgctttctcgttatcctttctctgtaggtgactctgaatctagctcttttcacggattgcatcaactgatatacgtcgtattcttcccaagttccctgcattcatgtcttatatatgctaactggacaattaatggctcatagcagggcagctgcctgtcagtgatcactccagcttggttgaatggttgagttagcctgtctgtttcatgatatctggtacaggtcccactcaataccgtttggtaggaatttatacttgtgatgtacttatgtcctcaaataagtccagggagaatatgaacgtaagcaaatttgtgattgctagacagacatgaaaaaccaaagtctagccatgcatgatctacagatttccttgtttcttccctccaactttgggaagtttgcactgaattaatacggttttgcttcatggtaggccattatatttgcaagtaatggtcctactagtataactggatcccaaatttccgatggagcatcacaatcacgatcatatgtcaagatcgatattatgctgtttggggcaaccgggcaaacatagcaccgggtaaactttggttcaacttacagttaatcagtagttaaccatgctgatatgataataagctgattagtccgtgtaagttaattaattaacctaccgggcatgcatgcaagttttggatggatttacataatggataagctggtactctgtttgtaaattctaatctactagcgtcctcaatttttttacttctccatttaaccagcgacccatgcattattctgtatttccgttgcatacttgcatttccatgcacgtgaactatgcatgacatgatgcatcttgatcaacgtggcacgtgcacgcatgcatgcaggacgcgtacgtcgtgaccacctcgcggaagcaccggccggtgccggagagccagctgctgagaaccgtcgtcctccacgacggccgcctcgcccagcgcccgacggcgatcaacacgctgctcgtcttcctctggatgccggtcggcttcgcgctcgcgctcctccgcgcgtgcctcagcctgctcctccccgagcgcgtcctctcctacgcctacaagctcacgggcgtcgggctcgtggtgcgcggccgcccgccgccgccggacgggagccccggcgtgctcttcgtgtgcaaccaccgcaccgtgctcgacccggtcgccgtcgccgccgcgctgggccgcaaggtgatctgcgtcacgtacagcgtccctcggaaaacgtacggcatgagctccaggctcccggaggcgctcacggcctcgccggtcaaggccgccgtcgcgctgtgcagggagcgcgacagggacgcggaccgtgtccggcggctgctggaggagggcgtcgacatcgtcgccttccccgagggcaccacctgccgaggggcgttcctgctgcggttcagctcgctgttcgccgagctcaccgaccgcatcgtgccggtggccatcgccaccagggagaccatgttccacggctccacggcgcgcgggtttaagggcatggacccttacttcttcttcatgaacccgcggccggcgtacgaggtcacgttcctgagccagctgccgagtgagctcacctccggcggcggcggcaagtcgccggtcgaggtggccaactacgtgcagaaggcgctcgccgggcagctggggtccgagcacatcggcatcacgcgcaaggagaagtag

SEQ ID NO: 95 - DNA, 2532 bp, Oryza sativa
tcaattggccttgggcttgtcggcggcggcggcgacccggccgtcgttgccggcgagcttcatgtacttgtccttcctggtgagcgtggtgcattggaaccctagctccttggcgatcaccctctgcacgtggttcgccacctccaccgcgctcctcccgccggcgacgcacgtctcctccggcctcagcgccggcaggaacgtcacctcgtaccccggccgcgggttcatgtagaagaagtaagggtccaggaacttccaccccctcgccgtcgacccatagtacgtcccctgcctcgcctccaccgccaccggcacgatcctcgccgtcagctccgcgaacagcgccgagaaccgcagcaggtacggctcccggcacgtcgtcccctccgggcacaccaccacgtccccctcctccagcagcgccgcgatgcgcgccgcgtccgccgcgcggtcccgcgtcagcgccgccgcgcggatcggcgagatcgccgtcgacagcggggctaacgctgtacgtaacgcacgtaacggggcggccaacgccgatggacacgatgaaggggtccgaggcggttccgtggttgcacaacaggagggagccccggcgtcccccgggcgcagcgggcgccgccgcgccccgcgcacggcgaggcggatgccggtgaggcggtaggtgtggcggacgaggcgcgccgggacggggaggttgaggaacacgcggaggagcgccacggcgaagcccacggggaggtaggccagcgcgaacagcgcgctcgctggctccgggcggcggacgaggcggccgtcgtggaagatggcgcgcgacagcagctcgtcggcggcggcgcgcggcgcgcgcttgttcttgggcaccatgtaggcttcctgcgcattggcaatttggcgccaaaacagagttagcacactaaggctgtgtttagtttcacatcaaaattgaaagttcggagaaattggaacggtgtaacagaaaagttggaagtttgtgtatgtagaaaaattcgatgtgacagaaaagttaaaagtttaaagaaaaaagttaaatctaaacaaggcctaatttttacaaatatctggctttggagtatattcatatgtacattttgaacacttgtcttctttttttttcgttaaataaaaacaaatattgatgatgggctaggttgcattctgaatgtaagcatgaaattttagtttatgatagtctaaccaattaaaaattgctagtggtcaaagttgaaacagtagagtcaatattcagagtaaatgcaaatggagagagtactaaatccacattaattgatgcaaagaaaacaatactatatgagtaaagtgatcaatgataatgatattactataacaagtcagcatgagcaaacaatatttgaatataggagtacatactaatttggggttttggttttaaaaaggacgaaataaataggaagcaactgctaactgcctactaaaggaggtgatggtaccaacagtattgagttttggccacaagttttgcataaccataatgtaaattctagagccttcttgatctttcctatgaaaagaggggaaaaaaaggcaattcaacaaaaaaaaaaggcaaaaagctaagaagcgtacatattcttgctactcgtgctaccacaaatgagccaatcggatcgaagccatgaacactcgaagaacaatcgagcgtgcaattcctaccacaattaatttcacaatattttctttttttatttttggcgttctaaatgaattgttaaattattagtggccacatgatgcaaaacttcaattttgttcatgtgtgattgattcaattcaagaaatgatgaaaatttcgagctttggatcgtaggccatgaagtgtaccttgcagatggccatgaagtcgtggtcgctctcgcggtcgccgaggccgacgtcgggcatgtcgccgccggcaaaaagcctctcgacgacctcgcgcttcttctcgccgacgaggacggccttgatgcggccggtaaaccgcttgccggaggcaaacgtctcgagctcggtcccggccacctcggcgccgaggaactcgcgcacgaactcccccaccatgacggccggcaacgcggtgacaagaacgcggcgtttggcccagccgtggaaaacggcccaggtttcggcgcgaaccccggcggcgtagtggcgcggcagcacggcgcgcgccacggcctcgacgtcgcggacgcgcagcccggcgaacgtgatgaacacgagcagggcgatggcggcggcctcggagacgccgacgtagagcgcgaggagccacggcgcggcgagcagcagcgccagcgcgcggaggtagctgccggcctcgagagccacaaggaagtagtacgggaacgccgacgacgacaccagcagcgtcccgtcgaggtccgccgccaccgtccgcctcgcgcccgccgccgcgtcgtacgccgtcaccggcggaaagaacctcctcctccccgccgccgccgccgccgccat

SEQ ID NO: 96 - DNA, 2941 bp, Oryza sativa
ctagttcttttccttctccttgttcttggaagggacgcggccgtcggtcccggcgagtatgctgtacttctccttgcgcgttatggcggtgcactcgaagccgagctggccgctgagcgtcttctggatgtagttggccacctcgatgggcgacttgccgccgctgcaagtgagctccttgggcagctggttcaggaaggtgatctcgtacgtcggccgcgggttcatgaagaagaagtaggggtccatgagcttgaagccccgcacggtggagccgtggaacatgctctccttggtgttgatcgccaccggcacgatgcggtcggtgagctcggcgaagagcgcgctgaaccgcagcaggaacggctcgcggcaggtggtgccctcggggcagatcaccaggtcgccctcctccagcagccgccggatgttctcggcgtccttctcgcgctcccgcgacagcgcgacggccttgatcggcgagatgagctccgagaacttggagatgctgtatgtgacgcagctgaccttgcggcgcagcgccacggcgacctcaaccgggtcgagcacggtgcggtggttgcagacgaagaggacgccaggatgtcccttcttggggggaggcggcgggttgcccttcacgatgaggcggatgcccatgagcttgtaggtgtagaagacgatccgctccgggagtggcaggttgacgtacacgcggaggagcgcgagcacgaagccgaacggcatccacaggaaggtgacgagcgccaccagcggcgtcggacgctgcacgaggcggccgtcgtggaggatgagtgggctcagcagctggttcttgggcaccgcgctgtacttccttgatgtcacgaggtaggcctcctgcacagacacgcagcatgcatgttacaaacacttcactgatgcaaaaatcacagcatcaccatcacttcttattttatcgaatatataaatgcttgttcatctcgccatgtacgccaaacctacatcctaccacgattacaattcagtacagtccactactgatggttccacagatgacagatcttcacatgcttaatcaaaattatgttttttcggagttaaactgttggatttaagttgacgtgtatcagccaatcaataggcgagagtagaccagagcagtggtaaagaagtacagcgattactgtaccgcaacaactgcaagactggcgcccataaatgggtgatttcccctccacgagagaaattcgttatacccccggggcagtgacagaaagacgggtcccatggagaagggaaagaaggggcaagaccatgaatggcagtatttatttcagtggttctctgcattaccggctggaagaaaggaagaaagaaagggaaagcaagggcagccgtggatctggcaggcacagccagcaccagctctgatgtctcacgcgccagccggccgatctccttcaatgcggccgggacaaggcttgaattctcaccaaacaaccgtaaataatggagccagccagccggccggacggactgactcgaccgtggcatactggcatgagtgaatccacgcattcaatccggcgggccacgggcgagtaaaaaccatcggcttccttccatgctctggctctgcccgcctccagattccttttctgatcatttgctcgagctttcgagttgttaagcttcaggtgaggatctagtatgtgcgacgtagacgttttgtgagttctgataatgaccttgatccttattattagtttactgattaaggatgttggtggaacagagcgaccggtcagtgcaggaagcttaaactgggtttcgcataatgggctgagcaacatctacagatcagtgtcataaatggcctgacaatgactatacacccctgctgttcgcgtgctcgaccactgtggcatactctactctgatctgaaaccactctactctgatctgaaacctctgcatgtttgtacagattgcagaatttatagtaggcggtgttcatagcttcgtcatagcaaaaatcaattgtaactgatgtgctaattccacgttatgaaagtaatatgtgtgatggagactatacttaattccaattttcatgtttcttgtttggaatgcagtaattccgaaataaacagagcattctatacggaatttatgtacaagatggtctaaccagttcgtagttgccagtaattggcagtgctactactaattcgtcgcaggacttgatcactgcaattaacaatcaacacgacagtactattactatgagcaaaaaatgagtttgagggggcgtcaaatttaccttgcatatggacatgaagtcgaaatccgtctccctgtcgcccaagccgacgtcgggcaccgcgtcgcgtagctccttgacgacggcctgcctcttgtggtcgcccacgagcactccgggcttcaccatgaaccccgtggccttgccgttcttgccgacctccagctccgtcccgaccaccttgtcggcgccgaggaacgtcttggcgaagtgctccaccatgatcctggggctcgccgtgatgatgtaccgcttgccgaaggagttgaacaccctccagctctccgggtgcacgtcctccgcgtagaacttgggcagcaccgaccgcgccaccatctcgatgttcctcaccttgagccccgccacggagatgtacaccagcgtgctgatggccagcgactcggagaagaaaatgtaggtcacgtagacgaacggcacggacagcagcagcacgacggcgcggagcacgctgccggcctcgagcgcgacgaggaggtagtacgggaaggcgctccgcgacctgaccagcgtgccgtcgaagtcggcggccaccgtctgctccgacctcccatccgagctgcactcctccacgggcttgaacctccgcgacaccat

SEQ ID NO: 97 - DNA, 1930 bp, Oryza sativa
ttaacatcccatggccttcttctcgtcgatgttgggcttggacacgacggtgccgtcgttgccggcgagcgccctgtacttgtccttcctggtgaagctggtgcactcgtaggagagcgtggaggcgatgagcctctggatgtagttggccacctcgtggctgctccggccgccgccgccgttgcaggtgagctcgccggggagcttgctgaggaaggtgaccacgtatccggggctagggttcatgaagaagtagaaggggtccagcgccttccaccccctcgccgtcgtgccgtggaacatgctcatctggttctccatcgccaccggcacgatctcgtcggtgagctctgcgaacagcgccgagaaccggaggaggaacggctcccggcacgtcgtcccctccgggcagatcaccaggtcgccctccgccagcagccgccggatcatcgccgcgtccgccgccctgtcccgcgtcagccgcaccgtcctgatcggcgacaatatctccgacagccgcgacacctgttcagacacgcaccaagatttttatttttaaaattttgaacaacttaaattttaaaatttaaaaataaacctttctaagatttattatcaacatctaaactttttgacaatgttagccgagttggcatcatacaggtctggctagcctaacagcgttgtcctgccacaccactctaggtaacgtggcagaacaaaactgtcacgcttgacacgacagtgtcattttgccatgttagacacaggctggcgtaattaaaatgttcaactttctaaaataagctatagaatagtttgtttttaatataaaaaaagaaaaattcaaaagttaatataaattccatgcaccggcgagttagctggtgagctagttgctcgccggagttggtggtggtgtgatcatgtgtactaccgagtaggtgacggcggtgatggggcggccgagggcggtggagaggaagatggggtcgaggagggtgcggtgggagcagatgaagagcacgccggactggccggtctcgcggctggccggtggcggcggggtgcccttgacggtgacgcgcacgccgagggcgcggaaggcgtggtacaccacgcgcatcgggaggagcgcgccggcggcgatgcggaggcaggcgagcacgaagccgatggggatccagagcacggtgagcagcgcgagcgccggcgacggcttctggaccaggcggccgtcgtggaacaccaccggcttcgggagctcctcccgcggcacgggcctcggcgtcggcgacaccggcaccacgtacccctccttgcatagcctcatgaacgggtagtccgtcctccggtcgccgatgccgatctccggcgaggcgtcgccgaacgcctcccggagcgcggccgccttgttctcgccgacgagcacgccggggctccggacgagccccgtggcgcggccacgccagaccacgagctccgtgcccacgacgatgtcggcgccgaggtactccttcaagaacgcctccaccatcatcctcgggttcgcggtgagcacgcaccggcgcccgcacgccgagaacacgcgccacgactccgggtggatgtcggagcagtagaacttgggcagcacggcgcgcgccaccgcctcaacgtcggcgaccctcgcgccggccatggacgcgaagatgagcacctggatgccggccgactcggacaccaggtagtagagcacgccggcgagcggcgccagcaggatcagcgccagcagccggaggacgccccccgtctcgaacgccatgtgcgcgaagtacgggaacgagctccggccgcacagcagcgtgccgtcgaggtcggcgacgatcgtgtcgccgccgcggtccttggacgaacacttctccaccgccgggaacggcgacgcgatcat

SEQ ID NO: 98 - DNA, 1960 bp, Oryza sativa
ttaacatcccatggccttcttctcgtcgatgttgggcttggacacgacggtgccgtcgttgccggcgagcgccctgtacttgtccttcctggtgaagctggtgcactcgtaggagagcgtggaggcgatgagcctctggatgtagttggccacctcgtggctgctccggccgccgccgccgccgccaccgccgttgcaggtgagctcgccggggagcttgctgaggaaggtgaccacgtatccggggctagggttcatgaagaagtagaaggggtccagcgccttccaccccctcgccgtcgtgccgtggaacatgctcatctggttctccatcgccaccggcacgatctcgtcggtgagctccgcgaacagcgccgagaaccggaggaggaacggctcccggcacgtcgtcccctccgggcagatcaccaggtcgccctccgccagcagccgccggatcatcgccgcgtccgccgccctgtcccgcgtcagccgcaccgtcctgatcggcgacaatatctccgacagccgcgacacctgttcagacacgcaccaagatttttatttttaaaattttgaacaacttaaattttaaaatttaaaaataaacctttctaagatttattatcaacatctaaacttttttgaccatgttagccgagttggcatcatacaggtctggctagcctaacagcgttgtcctgccacaccaccctaggtaacgtagcagaacaaaactgtcacgcttgacacgacagtgtcattttgccatgttagacacaggctggcgtgattaaaatgttcaactttctaaaataagctatagaatagtttgtttttaatataaaaaaagaaaaattcaaaagttaatataaattccatgcaccggcgagttagctggtgagctagctgctcgccggagttggtggtggtgtgatcatgtgtactaccgagtaggtgacggcggtgatggggcggccgagggcggtggagaggaagatggggtcgaggagggtgcggtgggagcagatgaagagcacgccggactggccggtctcgcggctggccggtggcggcggggtgcccttgacggtgacgcgcacgccgagggcgcggaaggcgtggtacaccacgcgcatcgggaggagcgcgccggcggcgatgcggaggcaggcgagcacgaagccgatggggatccagagcacggtgagcagcgcgagcgccggcgacggcttctggaccaggcggccgtcgtggaacaccaccggcttcgggagctcctcccgcggcacgggcctcggcgtcggcgacaccggcaccacgtacccctccttgcatagcctcatgaacgggtagtccgtcctccggtcgccgatgccgatctccggcgaggcgtcgccgaacgcctcccggagcgcggccgccttgttctcgccgacgagcacgccggggctccggacgagccccgtggcgcggccacgccagaccacgagctccgtgcccacgacgatgtcggcgccgaggtactccttcaagaacgcctccaccatcatcctcgggttcccggttaacaaggcaccggggcccggcaagccgaaaaaaagggccaagaatccgggtggatttcggagcattagaacttgggcagcacggcggggggcaccgccttaaagtcggggacccttgggccggccatggacgcgaagatgagcacctggatgccggccgaatcggaaaccaggtagtagagcaagccggcaaacggcgccagcaggatcagcgccagcagccggaggacgccccccgttttgaacgccatgtgcccgaagtacgggaacgagctccggccgcacagcagcgtgccgtcgaggtcggggacgatcgtgtcgccgccgcggtccttggacgaaaacttttccaccgccgggaacggcgacgcgatcatcggggggtcccccat

SEQ ID NO: 99 - DNA, 2311 bp, Selaginella moellendorffii
cttctgagccagcagtacaggggctggacggacttgaaaggcatttttctccagttccatttcaagtgagcacgttggaagcatttattctcctctgtggcgttctttctaactcggagttgtcccaggattcgacatggccgacttaaagtactcgcggctcgtccagttcggcctcgtggagaattgctcatctgaaggacgtggaatgcacacggttgcggcggatttggatggtacactgctcagacgcagaagctcgtttccatacttcctgctggtggctcttgaaggaggtagcctcttcagagcagttgttctcggacttttggcccctatcgcctggctgctttaccacttcgtctcggaggcagcagcaattcaacttctcatctatgtctctttttcggggcagaaggtgtccgagattgagaaggtggcaacggcggttctgccgaagttttactcccaggacgtccacagtgatgctttcagagttttctcgtcctgcgggaagaagtatgtcatcactgccaatcctcggatcatggtggagtatttctgcaaggccttccttggcgcggataaagttattgggactgaaatcgaagtggacgatgatggacgtgctacaggcttcgtcaagttcccaggtgtgctcgtgagtcaaaacaagaggaccgccttgaagctcgagttcgtggacggggagcttcccgagatcggactcggcgatcgagaaaccgacttcgccttcatgtcgctttgcaaggtaagcgcactctttccatatcatatacatattttgcatttcgagcatataatacttagctctgcctctttcgtgctgctttaactgttgaggggtgccaggatttgcgtgacactccagaatcagttacgagaagcgagttttctaactctggttgtaaccgtgtgatacaggaagcttacgttgttcccaagaggaaggttgacgcagtggacggcagcgctctggcgcagcgcgtgatcttccatgatggtaggctggtccagctcccaacgccgttcgtggcgctcgtcactttcctctggctccctatcggcttcgcgctcgcagtgctccggatcggcctcacctcccgttgcccccgaaagtacatgggaatgatctacgccatcctcggcgtccgccgcatcaccaaaggcaaagttcctcgcaaacaagacggcagggggctcctcttcgtgtgcaaccacaggactctggtggatcccatcttcctgggattggccgccgagagggacgtgaccgggctcacttacagcatcagccgggtgtccgaggtgctatcgcccatcgtcacggtccggctgacgagagacaaggagcgcgactttacgaagatgaagtcgctgctggagagggggagggacctgtgcctgtgtccggaggggacgacttgccgtgagccgttcttgctgcgattcagcgctctcttcacccagctcacgcacaggatcgtcccggcggccgtgaagacgaggcagagcatgtttaacgggacggcggtgcgggggtggaaggggatggatccattcttcttcttcatgaatccattcccgacgtacgaggtggagtttttggaggagctccccgcggagatgagcgtccaaaagggcggcaagagctcgttcgagacggccaatttcatccagaagatgctgggcgacaagctgggatacgagtgcacgaccttcacccgcaaggacaagtacctgatgctcaatggcagcgatggaacagtccccacgaaataggaaggggttggaaaagaaaacaagatggaaccgttggctggtgttgacttgaattgactagagttgacggttgaatactttttttttagtgttggctggctatctagcttgcactagtaaatgctaaaggttataggcaggcgattttaatccttccacatggctgggacaggaaatattgacttcgttcaattaaagggggaaaggttttagggcaggggtgttctagggcacggcagcgagctggcatcctcacaccggcagcatggcgtccggccggcggtacggcgctcgtgtctcgcattgccagagaaatgccactcccaacctccgccaccttttctctctccgccacctttgcgaactaaacaaatgtgttagaggaatcaaagatccaacacaccgaaacttcgtttttgttttcttcttgcctggtctttgtggaggcgaagaaaaaaaggaaacgagagagtctttgtacctttgggaatcaaactgctattgcgta

SEQ ID NO: 100 - DNA, 1989 bp, Selaginella moellendorffii
atgtcgctcgacggcggcaaggtcacggattctttcctggtagatgctccattcgagccggtggagcgatgctcgtcggcggggcgtgagaagcagacgtgcgtggcggatttcgacggtactctcatccgcggccggagctccttcccgtatttcatgctggtggcgctagagggaggaggcctcatccggagcgtgattcttggcctcttcgcgccgctcgcctggatcctctaccatttcgtctcggaatccgccggcatccgcctcctcatcttcatctccttcgccgggatgaaggccaagcagatcgagtcggtgtcgcgcgccgtgctgcccaaattctactcggaggacgtccacagcgaggcctaccgagtgttctcctcgtgcggcaagcgtgtggtggtgaccgccaatccccggatcatggtggagcacttcgccaagacgtgcctgggagcggacaaggtgctggggaccgagattgaggtgacgaggagtggctacgcgacgggattcctcaagcggccgggagttctcgtgggggtcaacaagcgcaaggctgtgaggcaggaattcggcgagcatttgccccatgtcggcattggcgatcgagccacggactttgctttcatggcgctctgcaaggtacttatctcgaatccaatcccgctctgcttggtgggtggagtggttgcttagttctcgatcgagctcgatgcattagatcaacactctgggcattgttttcgatcgatgatccatccctgcaattgctgcatgagtggatgattctcttgtttcttttgtttatcttttttccttgtctcatgcacacattcttacaagcgcactagcctaaaagaatctcttccaagcagcagtagaaacttctttccagtcaactaacgaacccatttgctgaccactatcaggaagcatacgtcgtcccaccctccaaagtggaggcgctgagccgagacaagctcgtcaagcccgttgtcttccacgacggccgcctcgtccagcggcccacgcccttgaccgccctcgtcaccttcctgtggctgcccgtcagcttcgtgctggcggtgttccggatcatggtcacggtaccctgcccgcgcgagtacgtgaccatcgtctacaagctcgtcggcatccggctcatcgtcaaggggccgatcccgccgcccaagaagcggggcgagtccggcgtgctcttcgtctccagccacaggacactgtgcgatccggtgttcgtgggggtcggggcccggcgggaggtgacggcgctcacctacagcatcagcagggtgtcggagttcctgtccccgatcaagacggtgggcctgtccagggaccgcgagagggacgcggccaagatcaaggcgctgctccagaagggggacctgtgcatctgtcccgagggaaccacctgccgcgagccattccttttgcgattcagcgcactgttcgcggagctgactgacaagatcgtgccggtggcgctgtgcacgaaggggagcactttccacgggacaacggtgcgcgggtggaaggggttggatccattcttcttcttcatgaatcccttcccgacgtacgaggtgacgtttctccagcagctgccgccggagctgacggtccagcagggcggcaagagcgcgatcgaggtggcgaatcacatccagcgggtgatcgcggacacgctgggattcgagtgcacgaacttcacccgcaaggacaagtacgggatgctggcggggaacgacggcaccgttccggagaggcggaggagcggcggcggaggtggcggcgccgccaaggatctcccgaaggacgagcaagcggcccaggggcaagaccaggtaaatggctgtagctaaaattgatttgcgaggatcgtggatccatgccatgggtcgggtctcacgcgctccttcgttataagtgaatgtaagctaagctactggcttgctctct

SEQ ID NO: 101 - DNA, 1554 bp, Selaginella moellendorffii
atggcagagtttccacccatcgaaaagtgtggcaccacaatcagccgcgagagcgaatcggtggcctccgatctggatggaacgctgctgcgcgggaggagttccttcccatactttttcctcaccactttcgagacgtcggggatcttgcgctcctggctgctcctcctcgtctcgcctctcgtctggcttctctatcacttcatctccgaggccgctggaatcaagctcctcatcttcgcttccctggcgggtgttccagtctctcagatcgaatgcatcgcccggagtgttcttccgcggttttatctccaggatctcaaccccgagacgtggaaggtcttctcgtcctttgggaagaagattgttgtcacagcgaatcccaggatcttggtggagtcgctctgcaaggaattcctaggtgctgacgaggtgattggaaccgagctggaggtggataaccgaggacgagcaaccggtttcgtcaagagccccggagttctcgttggagagaacaaagccaaggccttgctccaggcctgtgatcccgagcagctcccagacgttggacttggcgatcggcagaccgatttcccgttcatgaagctttgcaaggtacgtaacaaaagatcgtccctccttcccgcgacttagcagttctcacgctggcttctctcaatccaggaaggatacgtcgtccccccaagcaacaacgtggagccagttccaaagtcccagcttctgaagcccatcatctttcacgatggtcgtctcgtccagcttccgacgccactcgtggctctcgtcaccctcctctggatccccgtcggcttcgttctagcctgcctccgaatcgccgcaggctcgctgcttcccatgtcaatcgtgtaccatgccttctggctgctgggagtccgagtgaccgtgaaaggaacgccacctccgagagccaccaagaactcccgaggcgtcctcttcatctgctcgcaccggacgctgctagatccaatcttcctgtcgtgtgcgctgggccgaggcgtctccgccgtgacttactcggtgtcccgactgtccgagatcctcagcccgatcaaaacagtggctctctccaggaaccgctacaaggacgcggctcagatccgggagctcctgaaagaaggcgacctggtaatctgccccgagggaacgacgtgtcgggagccattcctgctgcgtttcagcgcactgttcgcggagctggccgacgatatcgtccccgtcgccatggacaaccggatgagcatgttccacggcaccgctgctcgtgcctggaaggggatggacccattctacttcttcatgaatcccagccccagctacgaggtaacgttcctccagcagctcccggaagagctcacttgcaagggcggcaagagctcccacgaagtcgcaaaccatatccagcgagctctggcgggagtgctagatttcgagtgtaccaatctgacgaggaaggacaagtacaaggcgctcgtcggcacggacggatcggtggagaccaagaagtcaacgtga

SEQ ID NO: 102 - DNA, 1554 bp, Selaginella moellendorffii
tcacgttgacttcttggactccaccgatccgtccgtgccgacgagcgccttgtacttgtccttcctcgtcagattggtacactcgaaatccagcactcccgccagagctcgctggatatggtttgcgacttcgtgggagctcttgccgcccttgcaagtgagctcttccgggagctgctggaggaacgttacctcgtagctggggctgggattcatgaagaagtagaatgggtccatccccttccaggcacgagcagcggtgccgtggaacatgctcatccggttgtccatggcgacggggacgatatcgtcggccagctccgcgaacagtgcgctgaaacgcagcaggaatggctcccggcacgtcgttccctcggggcagattaccaggtcgccttctttcaggagctcccggatctgagccgcgtccttgtcgcggttcctggagagagccactgttttgatcgggctgaggatctcggacagtcgggacaccgagtaagtcacggcggagacgcctcggcccagcgcacacgacaggaagattggatctagcagcgtccggtgcgagcagatgaagaggacgcctcgggagttcttggtggctctcggaggtggcgttcctttcacggtcactcggactcccagcagccagaaggcatggtacacgattgacatgggaagcagcgagcctgcggcgattcggaggcaggctagaacgaagccgacggggatccagaggagggtgacgagagccacgagtggcgtcggaagctggacgagacgaccatcgtgaaagatgatgggcttcagaagctgggactttggaactggctccacgttgttgcttggggggacgacgtatccttcctggattgagagaagccagcgtgagaattgctaagtcgcgggaaggagggacgatcttttgttacgtaccttgcaaagcttcatgaacgggaaatcggtctgccgatcgccaagtccaacgtctgggagctgctcgggatcacaggcctggagcaaggccttggctttgttctctccaactagaactccggggctcttgacgaaaccggttgctcgtcctcggctatccatctccagctcggttccaatcacctcgtcagcacctaggaattccttgcagagcgactccaccaagatcctgggattcgctgtgacaacaatcttcttcccaaaggacgagaagaccttccacgtctcggggttgagatcctggagataaaaccgcggaagaacactccgggcgatgcattcgatctgagagactggaacacccgccagggaagcgaagatgaggagcttgattccagcggcctcggagatgaagtgatagagaagccagacgagaggcgagacgaggaggagcagccaggagcgcaagatccccgacgtctcgaaagtggtgaggaaaaagtatgggaaggaactcctcccgcgcagcagcgttccatccagatcggaggccaccgattcgctctcgcggctgattgtgctgctacacttttcgatgggtggaaactctgccat

SEQ ID NO: 103 - DNA, 1757 bp, Selaginella moellendorffii
atggagcacccgtatgacgtgatcgacaattgctcggccgacaaccgcgagaagcagagcgtggtagccgacttggatggctcctgcgttcgcagccggagctccttcccttacttcatgctggtggctctggaaggaggcagcctcctgagaagcgtgctcctcatggtcatggcccccgtcgcgtggctgctctaccacttcgtctcggaggcagcaggcatcaaagtcctcatcttcttctcctgcgccggccagagagctcgggacatcgaagcggtggctcgcgcagttctccccaagttctactccgaggacgtccacagctccacctggagagtcttctcgtcgtgcggcaagcgctacattctcacggccagcccgagactgatggtggagcactttgccacgacatacctgggcgctgacaaggtgatagggacggagctgcaagtgacaaggagcgggtacgctacggggttcgtcaagagccccggcgttttggttggcgtcaacaagaggcgggcattgaaggccgtgtttggtgaggaggtgccagacctggggattggcgatcgcagctctgattatccgttcatggctttttgcaaggttggtacttctcgttctctctgagctctcttccttttcgcctgtagtcagcaggagcatatgcatatattgcagtgcatgctatgctagtctgtgatctttggagcaactcgtcgcctggctttctttttctttgattttgttgtatggttgttggtgtcaagtccgcgttgtcttcgttgtctccgtcgtcttctggctttatttcatccacggatgtggaacttccgagtctcaccagaactaataaagtcgcctctcttttttccttttcggctttgcaggaagcttacattgttcctagccagcctgccgacgccgttccagctcacaaactcgcgcgcaagattatctttcacgacggcaggctggtccagaggccgacgccgttcgtggcgctggtcacctttctgtggctacccgccggcttcctcctggccttcttccgcatcctggtggcgcttccatgcccggtcgagtacgtcccgctgctctacaaggtgatcggcgtccggctcatcgtcaagggcaaagtcccgccaccttccaagaacgggatcctcttcgtctgcacgcaccggacgctcatcgacccgataatggcctcggcggcctcggggagcgacgtgaccgcgctcacctacagcattagccgggtgtcggaggtgctctcgcccatcaagacggtgccgctgtcgcgggaccgggagagggacgcctcgaacatcaagcggctgctgctgaaggagaacttggcgatctgtcccgagggaacgacgtgccgggagcctttcctgctgcggttcagcgccctgttcgcggagctgtccgagaacatcgtcccggttgcgacgtcgaccaaaacgagcatcttccacgggacgacggtgcggggctggaaggggatggacccgttcttcttcttcatgaacccgttcccggtgtacgaggtgacgttcctcgagcggctgccgcacgatctgagcgtccaggggggcaagtcggcgatcgaggtggccaactacatccagagggtgctggcggacacgctgggattcgagtgcacgaactttacgcgcaaggataagtatgggatgctcatcggcagcgatggaacggtgcctgccaggaagaagtccttttga

SEQ ID NO: 104 - DNA, 2256 bp, Selaginella moellendorffii
agcttctgagccagcagtacaggggctggacggacttgaaaggcatttttctccagttccatttcaagtgagcacgttggaagcatttattctcctctgtggcgttctttctaactcggagttgtcccaggattcgacatggccgacttaaagtactcgcggctcttccggttcggcctcgtggagaattgctcatctgaaggacgtggaatgcacacagttgcggcggatttggatggtacactgctcagaggcagaagctcgtttccatacttcctgctggtggctcttgaaggaggtagcctcttcagagcagttgttctcggacttttggcccctatcgcctggctgctttaccacttcgtctcggaggcagcagcaattcaacttctcatctatgtctctttttcggggcagaaggtgtccgagattgagaaggtggcaacggcggttctgccgaagttttactcccaggacgtccacagtgatgctttcagagttttctcgtcctgcgggaagaagtatgtcatcactgccaatcctcggatcatggtggagtatttctgcaaggccttccttggcgcggacaaagttattgggacggaaatcgaagtggacgatgatggacgtgctacaggcttcgtcaagttcccaggtgtgctcgtgagtcaaaacaagaggaccgccttgaagctcgagttcgtggacggggagcttcccgagatcggactcggcgatcgagaaaccgacttcgccttcatgtcgctttgcaaggtaagcgcactctttccatatcatatacatattttgcatttcgagcatataatacttagctctgcctctttcgtgctgctttaactgttgaggggtgccaggatttgcgtgacactccagaatcagttacgagaagcgagttttctaactctggttgtaaccgtgtgatacaggaagcttacgttgttcccaagaggaaggttgacgcagtggacggcagcgctctggcgcagcgcgtgatcttccatgatggtaggctggtccagctcccaacgccgttcgtggcgctcgtcactttcctctggctccctatcggcttcgcgctcgcagtgctccggatcggcctcacctcccgttgcccccgaaagtacatgggaatgatctacgccatcctcggcgtccgccgcatcaccaaaggcaaagttcctcgcaaacaagacggcagggggctcctcttcgtgtgcaaccacaggactctggtggatcccatcttcgtgggattggccgccgagagggacgtgaccgggctcacttacagcatcagccgggtgtccgaggtgctatcgcccatcgtcacggtccggctgacgagagacaagcagcgcgactttacgaagatgaagtcgctgctggagagggggagggacctgtgcctgtgtccggaggggacgacttgccgggagcctttcttgctgcgattcagcgctctcttcaccgagctcacgcacaggatcgtcccggcggccgtgaagacgaggcagagcatgtttaacgggacggcggtgcgggggtggaaggggatggatccattcttcttcttcatgaatccattcccgacgtacgaggtggagtttttggaggagctccccgtggagatgagcgtccaaaagggcggcaagagctcgttcgagacggccaatttcatccagaagatgctgggcgacaagctgggatacgagtgcacgaccttcacccgcaaggacaagtacctgatgctcaatggcagcgatggaacagtccccacgaaataggaaggggttggaaaagaaaacaagatggaaccgttgactggtgttgacttgaattgactagagttgacggttgaattttttttttttggtgttggctggctatctagcttgcactagtaaatgctaaaggtttttcaagcaggcaggcgattttaatccttccacatgggtgggacagaaaatattgacttcgttcatttaaagggggcaaaggttttagggcacggaggggtggtctagggcacggaagcgagctggcatcctcacacaggcagcatggcgtccggccggcggtacggcgctcgtgtctcgcattgccagcgaaatgccactcccaacctccgccaccttttctctctcctggagttcttctgccacctttccgaactgaacaaatgtgttagaggaatcaaagatccaacacaccgaaacttcgtttttgttttcttct

SEQ ID NO: 105 - DNA, 2044 bp, Selaginella moellendorffii
atgtcgctcgacggcggcaaggtcacggattctttcctggtagatgctccattcgagccggtggagcgatgctcgtcggcggggcgtgagaagcagacgtgcgtggcggatttcgacggtactctcatccgcggccggagctccttcccgtatttcatgctggtggcgctagagggaggaggcctcatccggagcgtgattcttggcctcttcgcgccgctcgcctggatcctctaccatttcgtctcggaatccgccggcatccgcctcctcatcttcatctccttcgccgggatgaaggccaagcagatcgagtcggtgtcgcgcgccgtgctgcccaaattctactcggaggacgtccacagcgaggcctaccgagtgttctcctcgtgcggcaagcgtgtggtggtgaccgccaatccccggatcatggtggagcacttcgccaagacgtgcctgggggcggacaaggtgctggggaccgagattgaggtgacgaggagtggctacgcgacgggattcctcaagcggccgggagttctcgtgggggtcaacaagcgcaaggctgtgaggcaggaattcggcgagcatttgccccatgtcggcattggcgatcgagccacggactttgctttcatggcgctctgcaaggtacttatctcgaatccaatcccgctctgcttggtgggtggagtggttgcttagttctcgatcgagctcgatgcattagatcaacactctgggcattgttttcgatcgatgatccatccctgcaattgctgcatgagtggatgattctcttgtttcttttgtttatcttttttccttgtctcatgcacacattcttacaagcgcactagcactagcctaaaagaatctcttccaagcagcagtagaaacttctttccagtcaactaacgaacccatttgctgaccactatcaggaagcatacgtcgtcccaccctccaaagtggaggcgctgagccgagacaagctcgtcaagcccgtcgtcttccacgacggccgcctcgtccagcggcccacgcccttgaccgccctcgtcaccttcctgtggctgcccgtcagcttcgtgctggcggtcttccggatcatggtcacggtaccctgcccgcgcgagtacgtgaccatcgtctacaagctcgtcggcatccggctcatcgtcaaggggccgatcccgccgcccaagaagcggggcgagtccggcgtgctcttcgtctccagccacaggacactgtgcgatccggtgttcgtgggggtcggggcccggcgggaggtgacggcgctcacctacagcatcagcagggtgtcggagttcctgtccccgattaagacggtgggcctgtccagggaccgcgagagggacgcggccaagatcaaggcgctgctccagaagggggacctgtgcatctgtcccgagggaaccacctgccgcgagccattccttttgcgattcagcgcactgttcgcggagctgactgacaagatcgtgccggtggcgctgtgcacgaaggggagcactttccacgggacaacggtgcgcgggtggaaggggttggatccattcttcttcttcatgaatcccttcccgacgtacgaggtgacgttcctccagcagctcccgccggagttgacggtccagcagggcggcaagagcgcgatcgaggtggcgaatcacatccagcgggtgatcgcggacacgctgggattcgagtgcacgaacttcacccgcaaggacaagtacgggatgctggcggggaacgacggcaccgtgccggagaggcggaggagcggcggcggaggtggcggcgccgccaaggatctcccggaggacgagcaagcggcccaggggcaagaccaggtaaatggctgtagctaagattgatttgcgaggatcgtggatccatgccatgggtcgggtctcacgcgctccttcgttataagtgaatgtaagctaagctactggcttgctctctcgattgactcatcaggaatagatcgatcgggtggagagcatcgtgatcg

SEQ ID NO: 106 - DNA, 1715 bp, Oryza sativa
actcccacaccatcagcgagcacctagcggtcgcatcgctagctgccatctcctggtgagatccatcgagacgcccggcacgacgacgatggtgtcgcggaggttcaagcccgtggaggagtgcagctcggatgggaggtcggagcagacggtggccgccgacttcgacggcacgctggtcaggtcgcggagcgccttcccgtactacctcctcgtcgcgctcgaggccggcagcgtgctccgcgccgtcgtgctgctgctgtccgtgccgttcgtctacgtgacctacattttcttctccgagtcgctggccatcagcacgctggtgtacatctccgtggcggggctcaaggtgaggaacatcgagatggtggcgcggtcggtgctgcccaagttctacgcggaggacgtgcacccggagagctggagggtgttcaactccttcggcaagcggtacatcatcacggcgagccccaggatcatggtggagcacttcgccaagacgttcctcggcgccgacaaggtggtcgggacggagctggaggtcggcaagaacggcaaggccacggggttcatggtgaagcccggagtgctcgtgggcgaccacaagaggcaggccgtcgtcaaggagctacgcgacgcggtgcccgacgtcggcttgggcgacagggagacggatttcgacttcatgtccatatgcaaggaggcctacctcgtgacatcaaggaagtacagcgcggtgcccaagaaccagctgctgagcccactcatcctccacgacggccgcctcgtgcagcgtccgacgccgctggtggcgctcgtcaccttcctgtggatgccgttcggcttcgcgctcgcgctcctccgcgtgtacgtcaacctgccactcccggagcggatcgtcttctacacctacaagctcatgggcatccgcctcatcgtgaagggcaacccgccgcctccccccaagaagggacatcctggcgtcctcttcgtctgcaaccaccgcaccgtgctcgacccggttgaggtcgccgtggcgctgcgccgcaaggtcagctgcgtcacgtacagcatctccaagttctcggagctcatctcgccgatcaaggccgtcgcgctgtcgcgggagcgcgagaaggacgccgagaacatccggcggctgctggaggagggcgacctggtgatctgccccgagggcaccacctgccgcgagccgttcctgctgcggttcagcgcgctcttcgccgagctcaccgaccgcatcgtgccggtggcgatcaacaccaaggagagcatgttccacggctccaccgtgcggggcttcaagctcatggacccctacttcttcttcatgaacccgcggccgacgtacgagatcaccttcctgaaccagctgcccaaggagctcacttgcagcggcggcaagtcgcccatcgaggtggccaactacatccagaagacgctcagcggccagctcggcttcgagtgcaccgccataacgcgcaaggagaagtacagcatactcgccgggaccgacggccgcgtcccttccaagaacaaggagaaggaaaagaactagcgagtcacagcctcctatcgatcggagtactccgtattcgcccagccgactagtgtcactcatggcttctatctattgtttacgatttattgttgtttttcaagaagttggtaaattacatattgtttccgag

SEQ ID NO: 107 - DNA, 1521 bp, Oryza sativa
atggcggcggcggcggcggcggggaggaggaggttctttccgccggtgacggcgtacgacgcggcggcgggcgcgaggcggacggtggcggcggacctcgacgggacgctgctggtgtcgtcgtcggcgttcccgtactacttccttgtggctctcgaggccggcagctacctccgcgcgctggcgctgctgctcgccgcgccgtggctcctcgcgctctacgtcggcgtctccgaggccgccgccatcgccctgctcgtgttcatcacgttcgccgggctgcgcgtccgcgacgtcgaggccgtggcgcgcgccgtgctgccgcgccactacgccgccggggtgcgcgccgacacgtgggcggtgttccacggctgcgccgagcgccgcgtcgtggtcaccgcgtcgccggccgtcatggtgggggagttcgtgcgcgagttcctcggcgccgaggtggccggcaccgagctcgagacgttcgcctccggcaagcggttcaccggccgcatcaaggccgtcctcgtcggcgagaagaagcgcgaggtcgtcgagaggctcttcgccggcggcgacatgcccgacgtcggcctcggcgaccgcgagagcgaccacgacttcatggccatctgcaaggaagcctacatggtgcccaagaacaagcgcgcgccgcgcgccgccgccgacgagctgctgtcgcgcgccatcttccacgacggccgcctcgtccgccgcccggagccagcgagcgcgctgttcgcgctggcctacctccccgtgggcttcgccgtggcgctcctccgcgtgttcctcaacctccccgtcccggcgcgcctcgtccgccacacctaccgcctcaccggcatccgcctcgccgtgcgcggggcgccgccgccgccgccgcgcccggggacgccgggctccctcctggtgtgcaaccaccgcaccgcgctggaccccatcatcgtgtccatcgcgctgggccgccccgtgacgtgcgtgacgtacagcgttagccggctgtcgacggcgatctcgccgatccgcgcggcggcgctgacgcgggaccgcgcggcggacgcggcgcgcatcgcggcgctgctggaggagggggacgtggtggtgtgcccggaggggacgacgtgccgggagccgtacctgctgcggttctcggcgctgttcgcggagctgacggcgaggatcgtgccggtggcggtggaggcgaggcaggggacgtactatgggtcgacggcgagggggtggaagttcctggacccttacttcttctacatgaacccgcggccggggtacgaggtgacgttcctgccggcgctgaggccggaggagacgtgcgtcgccggcgggaggagcgcggtggaggtggcgaaccacgtgcagagggtgatcgccaaggagctagggttccaatgcaccacgctcaccaggaaggacaagtacatgaagctcgccggcaacgacggccgggtcgccgccgccgccgacaagcccaaggccaattga

SEQ ID NO: 108 - DNA, 1755 bp, Zea mays
aacccagacaggcaccgtaccaccgtgttccccgtcgccatggccgcgaggttccccccggtgtcgtcctacgacgcttcggcgcgggtccgccgcacggccgcggcggacctggacggcacgctgctggcgtcgtcgtcggcgttcccctactacttcctggtggcgctggaggccggctcctgcgcgcgcgcgctgctgctcctcctggccgcgccgctgctgctggcgctctacacgctggtctccgaggcggcggccatcgcgctgctggcgttcgtcacgttcgcggggctccgggtgcgcgacgtcgaggccgtcgcccggggcgtcctcccgcgccactacgccgcaggcgtgcgcgccgacacctgggccgtgttccgcgactgcggcgccgcgcggagggtcgtcgtcaccgcgtcccccgccgtcatggtcgccgacttcgtccgcgagttcctcggcgccgagctcgccgccaccgagctcgagacctgccgcgcgctcggcgacgcctggttcacgggcaggatcaaggccgtgctcgtcggggagaggaaggccgaggtcgtgcgccggctcttcgccgccggcgacctgcccgacgtcgggctcggggaccgcgagagcgaccacgacttcatggccatctgcaaggaggcttacatggtgcctccggaccggcgcgcgccgcgagcggccgcggacgcgctgctgtcccgcgccgtcttccacgacggccgcctcgtgcggcgcccggacccggcgcacgcgctcttcgcgctggcctacctccctctcggcttcctgctggcgctgttccgcgtgctcttcaacctcgccatgccggcgcgcctggtccgccacacgtaccgcctgacggggatccggctccgcgtgcgcgggactccgccgccggccccggcgccgggcgcgccggggtcgctgctggtgtgcaaccaccgcacggcgctggaccccatcatcgtgtcggtggcgctggggcggcccgtggcgtgcgtgacctacagcgtgagccggctgtcgacggcggtgtcgccggtccgcgcggtggcgctgtcgcgggaccgggcggccgacgcggcgcgtatagcggcgctgctggcggagggcgacgtggtggtgtgccccgaggggaccacgtgccgggagccctgcctgctgcgcttctcggcgctgttcgcggagctcacggaccggatcgtgcccgtggcgctggacgcgcggcaggggacctactacgggtccacggcgagggggtggaagtggctcgacccttacttcttctacatgaacccgcgccccgggtacgacgtcaccttcctgccgccgctgcggccggaggagacgtgcggcgccggcgggaggagcgccgtcgacgtggccaaccacgtgcagacgctcatcgccaaggagctcgggttccggtgcaccaagctcaccaggaaggacaagtacatgaagctcgccggcaacgacggcacggtcgggggcaggcctgagaatgagaagggcgccgccgatgatagtgctgccacggccaccaccaagaagcttgtataaagagactgtatttatagctagctggtcgactgtatcggagcagcatccattatgtatttatgtacgtatgctaatgacgacaacattagtgtgatgtgatggattcgtgaacatagaagattacaagcttaacttcatgtttaccatgaccaaaaaaaaaaaaaaaaa

SEQ ID NO: 109 - DNA, 1852 bp, Zea mays
gcgcgcgtatattaactccacctcgccgccccactccactgccaagcaactcgcacgcagcagtacgacgtctctcctctgggtctggggccgagacaccgagcacgtactaccagcaagatggtggcgtctcccagattcaagcccatcgaggagtgctgctcggaggggcggtcggagcagacggtggccgccgacctggacggcacgctgctcatctccaggagcgcgttcccctactacctcctcgtggctctcgaggccggcagcgtcctccgcgccgcgctgctgctcctgtccgtgccgttcgtctacgtcacctacgccttcttctccgagtcgctggccatcagcacgctggtgtacatctccgtggcggggctcaaggtgcgcarcatcgagatggtggcgcgctccgtgctccccaggttctacgcgggcgacgtgcacccggagagctggagggtgttcagctccttcggcaggcgctacgtcgtcacggccagccccagggtcatggtcgagcccttcgccagggccttcctcggcgccgacaaggtcgtcgggaccgagctggaggtcggcagggacggcaaggccacgggcttcatggccaggccaggcgtgctcgtcggcgaccacaagaagaaggccgtcgtcaaggagctcggcgacgcgctgcccgacgtcggcatgggggatagggagaccgacttcgacttcatgtccatctgcaaggaggcctacctggtgacgtcaaggaagtacagcccggtgcccaggaaccagctgctgagcccgctgatcgtgcacgacggccgcctcgtgcagcgcccgacgccgctcgtcgcgctcgtcaccttcctctggatgccgttcggcttcgcgctggcgctcatgcgcgtgtacatcaacctgccgctgcccgagcgcatcgtctactacacctacaagctcatgggcatcaggctcgtcgtcaagggcaccccgccgccgccgcccaagaagggccacccgggcgtcctcttcgtctgcaaccaccgcaccgtgctcgaccccgtcgaggtggccgtggcgctgcgccgcaaggtcagctgcgtcacctacagcatctccaagttctccgagctcatctcgcccatcaaggccgtcgcgctgtcgcgggagcgcgacaaggacgccgagaacatccgccgcctgctggaggagggcgacctggtcatctgccccgagggcaccacctgccgcgagcccttcctgctgcgcttcagcgcgctcttcgccgagctcaccgaccgcatcgtgcccgtggccatcaacaccaaggagaccatgttccacggctccaccgtgcgcggcttcaagctcatggatccctacttcttcttcatgaacccgcgcccgacgtacgagatcacgttcctcacccagctccccaaagacctcacgtgcagcggcggcaagtcgcccatcgaggtggccaactatatccagaagacgctcagcggacagcttggcttcgagtgcacgtccatcacgcgcaaggagaagtacggcatgctcgctggcaccgacggccgtgtcccgtccaagaacaaggagaaggagaaggataagaactaacggccaacgtcgctcttcctgcttgcccagaagactgccgtttaattactgctcaaatttattccaatttattgttccttgtcgaaaagttggccagtgtgatgtgggccgtgtactagtacaagcttgatgatcattagtatgtctacaattcttcctttccggaagaagggaggaagagttgatagagccgtcttaatacaaagtttcgccaaaaaaaaaaaaaaaa

SEQ ID NO: 110 - DNA, 1704 bp, Zea mays
caccaatataatcaccatttctgttcacgcgatcgagaggcaaaattaagcatggtgtcccgaaggttcaagccgatcgagctgtgcgactccgaggggcggtcgcgccagacggtcgccgccgacctcgacggcacgctcctcctgtcccgcagcgcgttcccgtactacctcctcatcgcgctggaggccggtagcctccttcgcgcggtggcgcttctcttgtccgtgcccctcgtgtacctcacctacgtgaccgtgtccgagaccctggccgtgcgcgcgttcatctacgtcgccatggccgggctggaggcgagggacatcgaggccgtcgcccggtccgtgctccccagcttctacgccggcgacgtccacccggagggctggcgcgtgttccgctcgttcggcaggaggtgcgtcgtcaccgccagcccgcgcctcatggtggagccgttcgccaaggcgtttcttggcgcggacgtggtgatcgggacggaggtggaggtggcccagtccgggaaggccacggggttcgttgccgggcccggggtgctcgtcggcgagcacaagaggcgggcggtggcgagggagttcggcgactcgctgccggacgtcggcatgggggatcgcgagagcgacttcgacttcatgtccatctgcaaggaagcgtacaccgtaacacgacagaagtaccgcgcgctgccccgggatcagctgcagggccgggccatcctccacgacggccgcctggcccgccgcccgacggcgaccaacgcgcttctcactttcctgtggatgccgctcggcttcgcgctcgcgctggtgcgcgcgcatctgcacctgctcctcccggtgcgcgccctcgcctacgcctacaagcttacgggcgtcaagctggtggtgcgcggcaacaggccgccgccgtccaagaagaagaagggcgaccagctaggggttctcttcgtgtgcaaccaccgtagcacgctcgacgccgtcgcggtgggcgtcgcgctgggccgcaaggtgagatgggtcgtcacagacggcggtgcgggtgcctccaggttctcggagcccgtagtgtcgcctatcatgacaggcgtgccgctgcccgtgcccaccagcctcgagggcgacgccgacgcggacgccgccccccgcatccggcggctgctcgaggagggagacgacgtcgtcgtcttccccgagggcgccatctgccgcgagccgttcctgctgcggttcggcgcgctcttcgctgaggtcaccgaccgcatcgtgcccgtggccatcgaacctagggagagcatgtttcacgggtccacggcgcgcgggctcagagggatggatccctacttctttttcatgaacccacggccgacgtacgaggtcacgttcctgaaccagcttccaggggagctcacctgcggcggcgggaggtcgccggtcgaggtggccagctacgtccaggaggtcctggccgcgcagcttggattcgagtgcacctgatgaagcagcaagtgcaaaagtggcatggtgacggttgcgtggcgttcaaaggtggactagggaacacagagcatgcaaccaactgtcaattgccgtgtgttgagagtggtgatcagttcatggtttcacgtttgctgttgatgtctgtgataagaaccatatgtatctctacaactattaagagcgttgtgt

SEQ ID NO: 111 - DNA, 3202 bp, Brassica napus
ccgcaaagatccgaaccgaacctgaaccgaaatttagaaatacccgaatggggctgaaatctttaaacccgaaaacccgaaacccgattagatccgaaccgaacccgaatgggtacccgaatgcccacccctaacatcatctataaaataaatatattcatatataacatttcaaatttcgaaatattattatttttgtataatttgtattactaaagttttcaaaaatttctacaatttttttaaaaaataaatatctaatcgtaaaatcattagtttcttatatatctacaaattttataaatattgtttaggctaaatttttgataattatatagtttttattaattttatacaaattgatttaatatatattaaatctatattaaatattagtaaaaaaatagtaaaatatataatatttaataaatttatttttaaatataaattagatttaaaaaattccttgctgaaaaacacctagtagtatatcataaaggatgtttattgcgatgtgtaattttaaatctaatgggggacaaagtgagaatcagggttataattgttagaaaaggatagttaaaggataaaatcgtaaagaggtcatattgattggagtgataactaatagttgagcggttaaccactttgaatgagcgcatttaaaacagagaccccttccctctctttctttcccaaattgacaaaaagactcaagagagaaagaaagaaaatgtctccggcgaagaagaagagcacaagctttcctccgataagcgagtgtaaaagcggagagtatgattcgattgctgcggatcttgacgggactcttctcctctcgcgaagctccttcccttatttcatgctcgtcgccatagaagcaggcagtctcttccgtggattgatcctccttctatctctcccgatcgtcatcatcgcttacctcttcgtctccgaagctctcggcatccaaatcctcatctacatctccttcgccggcatcaaaatccgcgacatcgaactcgtctctcgcgccgttcttccacggttctacgcggcggatgtgaggaaggacagtttcgaggtgtttgataaatgcaagaggaaagtggtggtcactgcgaaccccatagtgatggttgagcctttcgtgaaggattacttgggaggagacaaagttttaggaacagagatcgaagtgaatcctaaaacgatgaaagccactgggtttgtgaagaagcctggtgttcttgttggcgatttgaaaagattagccatcttaaaggagtttggagacgaatcaccagatcttggccttggtgaccgcacctccgatcacgacttcatgtccatttgcaaggtgcgtattatctccttttccaagcttattttacgtttcttgaatcgtttaaacacccgatttaggtggcctagttaattaagttgagtgtctgatacttcaaaaacctttcgtaatcaaagaatttaagtactttaaataaatgcagtaggacctatattaatgccgcgttaagggttcacatgatctagctagtgggatagattatacaataatttgtccatccaccccccttttttttaacattaacagccttcacatgatccatttacgtccagatgatttatttactttgtatgtgtatgtctgcatggaaacaattagattaagtattcttctaatgtttttgaaaaactgatttagcatacaaaaaaaacttgtaatcatacgtatatgtgaattcaataaatgaatgtaataaaattcaacttacaaaaagtaggtagatagaatatgatagaagtagtagttttcataaatgctttaaacctatcaccaactaccatccccacgtaagttggatggtccatttaatgaccgatcccatatgtcaacattttttttctttttttttctcatataccctgaaactttcagtattttaccatatttcttactataatagtgaaacttttgaatcttttaaatgattggtaacgagttgcttattttaattgtaacaggaaggttacatggtgcatgagaccaaatcagccacaacagtccccatagagcgtctcaagaaccgcataatcttccacgacggccggctagtccaacgtccgacgcctttaaacgccttaatcatttacctttggcttcctttcggcttcatgctttccatcttccgcgtctacttcaaccttcctctacctgaacgcttcgttcgttacacttacgagatcctcggtattcacctcactatccgcggccaccgtccccctcctccttcccccggcactcccggaaacctctacgtccttaaccaccgtactgctcttgaccccatcatcatcgccattgctctcggccgtaagatctcatgcgtcacttatagtgtctctcgcctctcccggatgctctctcccatccctgccgtcgctctgacccgagaccgtgccgccgatgctgcccgcatgagaaaactcctagagaaaggtatttgtaacagcagtccttattactataggcagagtgactctgaatctttactagaaaattggtttgaaaaagataatataacaactacttcataaatatcagaaacagagtatctctcactttttggatacataactggtctcatttttatcacatttggtctagtctgaatatttaatcatattcatgcgtagaataagataactttcgtctatataaaagtagaaaagagagcatctctataagtgttttactatatttgcgacaggtgatttggtgatctgccctgaaggcacgacttgtagagaaccgtatctgctgcgattcagtgctctatttgcagagctaagcgaccggatcgtacctgtggccatgaactgtaagcaagggatgttcaatggaacgacagtcagaggtgtaaaattctgggatccttacttcttcttcatgaacccaagacctagctacgaggccactttcttggaccgtttgcctgaagaaatgacggtaaacggcggcggtaaaactccaatcgaggtggctaattacgttcagaaggtgattggtggagtattggggttcgagtgcactgaacttacaaggaaggataagtatcttttgcttggaggcaacgacgggaaggttgagtctatcaagaagacaaaggatgataaatccagc

SEQ ID NO: 112 - DNA, 1872 bp, Arabidopsis thaliana
caatataggtgcatttaaaacataacgttccctctcttgtcttcttatttttgctctctgttctttagaactgccattaacgagagtgagagagagagacacacacacagcgagtgaaaatgtctccggagaagaagagtcaaaacttccctccaataacggaatgcagagacggagagtacgattcgatagccgccgatcttgacgggactctgcttctctcaagaagctccttcccttacttcatgctcgtcgctgttgaagctggaagccttttacgtggactaatcctccttctctcgttaccattcgtcattatctcttacctattcgtatccgaatctcttggtatccagatcctcatcttcatctcattcgctggtctcaaaatccgcgatatcgaacttgtctctcgcgcagttcttccacggttttacgcggcggatgtgaggaaagacagttttgaggtgtttgataagtgtaagagaaaagtggtagtgacggcgaatccgattgtgatggtggaggcgtttgtgaaggattatcttggaggtgataaagttttgggaacagagattgaagttaaccctaaaaccaatagagccactggatttgtgaagaagcctggtgttcttgttggtgatcttaagaggttagccattttaaaagagtttggtaacgaatcacctgatctcggcctcggtgatcgaacctctgatcatgatttcatgtctctctgcaagaaaggttacatggttcatgcgaccaagtcagccacaacgattccaaaagaacgcttaaagaaccgcatagtcttccatgatgggcgtttagcgcaacgtccaactccgttaaacgccattatcacatacctatggcttccttttggtttcatcctctccatcattcgcgtctacttcaacctccctttacctgaaagatttgtccgttacacttacgagatgctcgggatccacttaaccattcgtggtcatcgtcctccacctccttcccctggaactcttggcaacctctatgtccttaaccaccgtaccgcgcttgatcccatcatcgttgctattgctcttggacgtaagatctgttgcgtcacttacagtgtctctcgtctctcccttatgctttctcctattcctgctgttgccctcacccgtgaccgtgccaccgatgctgccaacatgagaaaacttctcgagaaaggcgacttggtgatatgtccggaaggcacgacgtgtagagaagagtatctactgagatttagcgctctattcgcagagctaagcgaccggattgtgccagtagcgatgaactgtaaacaaggaatgttcaacgggaccacagttaggggtgtgaagttttgggacccttacttcttcttcatgaacccaagaccaagctatgaagccactttcttggatcgtttgcctgaagaaatgactgtcaacggtggtggcaagactcctatagaggtggctaattacgtccagaaagttatcggcgcggttttgggcttcgaatgcaccgaacttactcgcaaggataaatatcttttgcttggaggtaatgacggcaaggtggagtctatcaacaacaccaagaagtgaatatcttattcttgttataacttggcattgacttattgcaagtaaggttggatcatatacgaattttcatgtgtgtaattgcttgagctcttgtcatcattatggtacgttattgttatgtttattctattttgttcttaatgtcgaacgggtaactatatccttaaaaactattttgtgatcccgtttctatacggatgtgtatagagactttctatttaaagtgcaaaattttattggaggaagtaaa

SEQ ID NO: 113 - DNA, 1545 bp, Physcomitrella patens
atgcagcaactcgacccattgactagttttcactgcagtgaaagcttcgaaggagtggagacctgcagagtggaagggcgtgcgaaccagagcattgtttcagatttggacggaacgcttctgcggtcaagaagctcttttccctactttatgttgctcgctttcgaagcagggagcccactccggtctgtcgttcttctgcttatttctcccgtagtatggcttgtctacaacttcgtctccgaggcagctgggattaagatgctcattttcgtctcgctggcgggactcaaagtgtccgccgtcgagtcagtggcgcggggtgttctgcccaaattctacttggaagacatgcactccatcagctaccgagtcttcacctcctgcgggaagcgctacgtcgtgacggcgaatccaaggatcatagtggagccgtttctgaaagagtatcttgacgtagaagctgtaatgggcactgaactacaaatctcgagcgggggatatgtcaccggttttgtaacgggccccggtgtactcgttggtgctgtcaaagagcgagctgtgaagaaatactttggacccgaccctccggacgtcggcctaggagacaggcagagcgacttcttattcatggatctctgcaaggaatcttacattgtacacagcgacaaggatgtgcccgccgtgtcgaaggaagacttcttaaaacctcttatcttccacgacggtagactggtgtgccgtcctacgccgctgatgtcgcttatcgtcatgctatggtgtcctattggctttgtccttgccgttgttcggatgctcatcggcattgcgttgccaatgtggtgggcgcttcctcttgaggcaatgctcggcgtcaccgtccgtgtgaaaggaattcccccgacgtgccccctccgaaacaagaagcggggtgtgctcttcgtgtgctctcatcgcactcttcttgaccctattttcttgtccattgccgttcgaaggaaagtcactgcagtaacatacagcatcagtcggctctccgaagtgctgtccccaatccgcactgtgcgcctcacgagggacaggaacacggacgccaacaccatggcaagtctattggaggaaggtgaccttgtggtgtgccccgagggcaccacttgccgggagccttatctgttgcggttcagttccttgttcgctgagctgacggatcaaattgtccccgtgacgatgaatatcaaaattaccatgtttcatgggacgagcgctcgaggctggaaaggcatggaccccttcttcttcttcatgaacccttgccctaagtatgaggtaacatttctggaccaactcccgcatcagctgacatgcaatggcggaaagaccagccacgaggtggcgaactacattcagcgcgtgttagcgaactctcttggatttcagtgcaccaatctcacgcgcaaggacaagtatactgtattggccgggaacgatgggattgtgccggatcacactctgcggcagcgagctggcagaatgttcggcttgtag

SEQ ID NO: 114 - DNA, 1506 bp, Physcomitrella patens
atgaagagagatcccttcgataccatcgacaagtgcagtgacaaaggcagaagcaagcagacggttgtctcggatctcgacggaactcttcttcgcagccgaagctcgttcccctacttcatgctggtggcattcgaagctggaggagtggcccgggcctttgtgctcctcttgtgctctccgctgtgttggcttctgtaccattgcgtctcagaatccatcggcattcgcctcctgatctttgtcaccttcgcgggcctaaaaatcggcggtatcgaagccatcgcacgcggaacgttgccaaagttttacgcggaagacgtgcatccggacacatggcgaatcttttcttcgtttggggagcggtacatacttacggcgacgccgcggatcatggcggagaccttcgccaagacgtatctgggagtggacggtgtgttggggacggagctgcatttcacttctggcggcatcgcgactggtttgttgatgaacccaggggttctaaccgggagaaacaaagaaattgtgctgaggcaagaattccaaggcttgaaccttcctgacgtgggtctcggagaccgtccgtccgaccacaacttcatgtccatttgcaaagaaggatacatcgttccgccgagcaacacaatactggcagcgtcgaaagaaagtctaatgaacctgctggtgtttcacgacggccgcctgatccaaaggcccacagcaggcatagcgctcatcatactgctgtggtacccgattggcgctgtgttggccgtgcttcggatcctggctggcatccttcttcccttccacttgttgaaattggtatacaagtttcttggggttggggtggtggttcgtgggaccccacccccagagcccaaagacggccccggacgaggaggctacctgtacgtgtgctcgcataggacgctactagaccccgtgatggtgggcgtggcgttgaagcggcgcgtgacggccgtcacgtacagcataagccggctgtcggaggtgttgtccccaatcaaaacagtggcactgaagaggaatcgggagaaagacgcggcgaagatcaggtctctgctgcgagaaggagaccttgcgatctgccccgagggcaccacctgtcgggagccgtatctgctgcgattcagcgcgctgttcgcggagctgtcgaaccagttggtacctgtggcgatgaacacgcgcatgagcatgttccacggcaccaccgcgcaggggtggaaatgcttggaccctttctacttcttcatgaatcccaaccctatctatgaggttacgttcctcaacgaattaccggttgagcttacatgtgccggtgggaaatcttcgtatgaagttgcgaaccacatccaacaacttttgtcgcaaacgttgggctttgaatgcacaaattatacacgaaaagacaagtatggggtgctctgtggaaacgacggttcaattcctttaaagtctcaagactcctttggttcgtag

SEQ ID NO: 115 - DNA, 2100 bp, Physcomitrella patens
atggagacgcaagaacccgaccctgtcacaagctttcactgcagcgaaaactatgacgaggtggagaactgcagggtggagggtcgggcaaatcagagcattgtatcagatttggacggaacgcttcttcggtcgcgaagctccttcccctatttcatgctgctagccttcgaagccggtagtccattacggttcatcattcttcttcttgtctctcccatcgtttggttcgtctacaacttcatctctgaggtagtcggtattaagatgctaatattcatatcgcttgcggggctcaaagtgtcagccattgagtcagtggcgcgtggtgtactgccgaaatttttcttggaggacatgcactccatcagctacagagtgtttatttcctgcgagaaacgctacgtcgtcacagccaatccaaggataatagtggagccattccttaaggagtatttagatgtagacgctgtgatgggcaccgagcttcaaatttcgagtgggggatatgctaccggcttcgtcaccggccctggtgtcttagtggggacagcgaagcaacgagctgtgaagaaatattttgggtccgaccagccggaccttggcctaggggaccgaacgagcgacttcgcattcatggacctctgcaaagaggcttacatagtgcctagctataaggaggtgccgtccgtgacgaagaaagactacttgaagccgttgattttccatgacggaaggctggtgtgtcgtcctacgccgctgatggcgctggcggtgacactttggtgcccgattggcttcgtcttggccatcatccgaatgttcattggcataatgttaccaatgtggtgggctctccctctagaagccatgcttggcgtcacggtccgtataaagggaattcccccgacatgtccccttcggagcaagaaacgcggcgtgctgttcgtttgttcacatcgcactctcctggaccccattttcttgtctatagccgtgcgaaggaaagtcacggcagtgacgtacagcatcagtcggttgtcggaagtcctggctccgatccgaactgtacgtctcacgagagacaggaacacagatgcgagcactatggctagtctcttggacgagggtgacctcgtagtgtgtcctgagggcaccacttgccgcgagccttatcttctgcggttcagttccttgtttgcagaattgactgaccaaatcgtccccgtaaccatgaacatcaagatttcaatgtttcatgggacgagtgctcgaggctggaagggcatggatccgttctttttctttatgaacccccgccctaagtacgaggtaacattcttagatcaactcccgcatcagttgacttgcaatggcggaaaaactagccacgaggttgcgaattacatccagcgtgtgttggcgaactctctcggatttcaatgcaccaatcttacgcgcaaagataagtacagggtgttggcggggaacgatggaattgtaccagatcgaagtctgcggcagagggccagcagaatatttggtttgcagtgacattagggtttacttgtaacgccacatgtcaaatcgcagcatcggatggtcctgtacccaaataatttcctaggtggcggaggaccgatttttttcctcaaattgtgcggagttagggaaaaccttcggtccccagctatgacccacatgtgctgcgttgtctgcatccagcccgacctcaactgtgtcgagcttctgctgttgattgattgacaccgactagaaaccaaatagtacaattttaagaggataaacatcgtgttataatttggaaagttgaaccatacaattcctttctatcagttacagcgtttgactaactacagaaacaggaagacactgttggacattgctctatctgcggcggtaaaaaggacactggctgcttttcagagacgacatataacttcggcttatgactgagttcttgttgctcctcaaaccttgaactgtaggactgtagctagtgtctctgctgtctcgcctgtaagcagaagcattaggcgtttgtattgtgtattattcctaccattcattgaaggacat

SEQ ID NO: 116 - DNA, 1676 bp, Physcomitrella patens
atggaggtgacgaagttgaaagaggccgggaactacagcttcgcggaggtgaaatcgtgcagctcagggaatgatcgcaggagccagaccgtggtggcggacttggacggcaccctcattcgggggcggtccgctttcccgtatttcttcctggtggcgttcgaggccgggagttacttcagggcgctgctgctgtcgctcatggcgccgctcattgggtttctctactactttgtggacgaggcgtccgggattcacctcatgatctttctctcattcgcggggctgaagattaaggacattgagggtgtggcgcgcgctgtgcttaccaagttctacgccgatgaccttcaccctgagacttggcgggtgttctcgagctttggcaagcgtgtggtgctgacggcaaacccgcgcgtgatggtggagccgtttctgaaggaggtcctcggcgcggacgaggttatggggacggagattgaggtgaacaaaaagggccgcgctacaggcaggcttctgaagccgggtgttctggttgggacacacaaggaggaagctctaaagcggtgtaacattggaggtgagcgcccgcacgtcgggctaggcgaccgcgttacggatttccctttcatggcgtactgcaaggaaggctatgtagtacccaaaacgaaagtgccagccgttaagaagcaagacatgccgaagcagctaatctttcatgacggtcggcttgtgcaactcccaacgccccgtaatgctttcaaagtgctggcatggatgcctatcggcctgcttttgtccatcgtccgcgtcacgatgggtgtatgggtccccatacgcttgatgccactgtgttacaaactcacaggcatcaacctcgttgttaagggaaacatccctgagaagcccaagaatggagaacccgggagactcttcgtctgcaaccaccggactcttctggaccccgtcatcatcgctctggcgcttgggcgccccgtccctgccgtgacttactccatatccaaagtctcagagttcctgtcccccatgccaacaatcggcctgtgccgagatagggagaaagactcggccaatatgagaagggtgctgaaagagggtgagctcactctttgtcctgagggcactacttgcagggagcctttcttgcttcgattctcagctctcttcgccgagttgagtgacaggattgttcctgtggccgtaaaaattaacatgaatatgtttcacggcacaactgctcgcggtaacaaagccatggaccccttctttgcttacatgaaccctcggccgaccatcgaactcaaattcctagacgagattccaaagaacatgacatgtggtagcggaaaatcgtccattgaagtggcgaactacatacaacatctccttgccggagaactcggatatgattgcacagatttcactcgcaaggataagtaccggttgctcgcaggaaacgatggcattgtacctgttaaggagaaaacgaggtaatgaatcgacctgcaagcacattaccacagaacaagacattgaaagtgcttacgattcagtatcactagatggaggggttaaccccgactcagtactataagtgtagaattcagtgccaaaggcaataaactgtgattgattgttacataaactcgatgcaa

SEQ ID NO: 117 - DNA, 1590 bp, Physcomitrella patens
atggaaattccaggagtgtttgatgctaatctcttctgcgctgagtcatttcctgaagtcgaaacttgtaaagtggaaggtcgtgaaaaacagacgattatttcagacttagatgggacgctcctcagatcaagaagctcgttcccttacttcatgctcattgcgttcgacgctggaagccctctccgcttcatcgtcctcttgctggcctctccaataatttggctggtctacaacttcttctccgaggctgccggtaccaaactgctcattttcattgcatgtgctggcttgaaagcgtccgacatcgagtctgtagcgcgcggcgtgttgcccaaattttacttggaagacatgcactccgtcagctacagcatcttcgtctcctgcggtaagcggtatgtggtgactgcgaatccgcgcatcatggtagagtcatttctgaaagagtacatgggcgtcgaggcagtcataggtactgagcttcatatcacgaagagcggttacgccacgggtttggtaatgggtgccggtgtgattgtgggagctaacaaaacgcgcgctgtgaagaaatactttggcgatgaccttccagacatcgctctcggagaccgagccagcgactttccttttatggctctttgcaaggaggcatacttagtaccgagcttcaagcctgtcgagccagttgccaaagctgactacctgaagccgctcattttccatgacggcagattagtatgtcgaccaacacctctcatgtcactcgtaattattctctggtcgccgatcggtcttattctagcactcattcggatggtgtttggcaccgtgttacccatgtggtatgcgctgccgctggaggccatgcttggcgttagcatccgcgtgaaaggaatcccccccagctgcccccaaaccagcggcagacgcggtgtgctcttcgtctgctctcaccgcactttgctcgaccccatcttcctgtcaatagcctgtcggcgacaagttacagcagtaacctacagcatcagcaaggtctcggagatactgtcgccgatccccacagtccgactcacaaggtgtcggaaaaccgatgcggagaccatgacaaagcttctcaacgagggagatcttgcagtgtgcccagaaggcacgacgtgccgcgagccataccttcttcggttcagctccttgttcgcggagttagccgaccaaatcattcccgtcacgatgaacgtcaaaacgaccatgttccacggcacgacagcccggggctggaaggcactggacccctttatctttctgatgaatcccagccctaggtatgaattggagtttctagatcagcttccgcacgagatgacctgcagcggcgggaagagtagtcacgaggttgcgaactacattcaacgagtcctcgcggcatctctgggtttcaagtgcacgaacctgacgcggcgagacaagtatcgaatcttagcagggaacgatggcgtggttcctgcaagccattttttgaaacaaagaagcaggatcttcgcatgcttgccttccaggaatagtgagagaggccagcgatcagacccgtaa

SEQ ID NO: 118 - DNA, 1512 bp, Vitis vinifera
atggctgtaactacctttccaactgtggaccagtgtcaatccattggccgagaaaagcacactgtggttgcggacatggatggaaccttgcttattggcaggagctcctttccttactttgctttggtggcttttgaggggggaggtgttctaaggctgctcttcctgctcttggcttcaccactcgctggacttctttactattttgtgtcggagtctgcaggaatccagattctcatctttgtaaccttcgctgggatgaaggtgtcagacattgagtcagttgcacgtgctgtgctgcccaaattttatttgagcgatctccatcccgagtcatggcgggtgttctcatcatgtggaaagcgttgtgttcttaccgcaaaccccaggataatggttgaggcatttctgaaagattttttgggagctgatttagttttggggactgagatagccacttataagggtagggcaactgggtttgtttgtgatccaggtgtacttgtgggcaagaacaaggcatatgctctcaacaagacttttggagagacccagcctgagattgggctgggtgatcgtcacactgattttcccttcatggcttcatgcaaggagggctatattgtggcagccaaaccagaggttaaggcggtaacaagtgacaagcttcccaagcccatcatcttccacgacagccgcctcgtccaaaagccaactcctctcacggcactcctcacccttctctggatccccataggcttcgcactcgcatgcttgcgaatcgccgctggctcactcctccccatgcgcattgtctaccacgctttctgggcactgggtgtccgagtctccgtcaagggttccccacctcctgttgccaaaaagtcaataggccagtcaggcgtgctattcatctgctcccaccgaaccctccttgacccaatattcctctccgcagcgctcggccgtcccattcctgcagtcacgtactccgtctcccgcctctccgagttcatctcccctatcaaaaccattcgcctaagccgagatcgagtcaaagacgcagccatgataaagaaactgcttgaagaaggtgacctagctatttgccccgaaggaaccacttgccgtgagcctttccttctcaggttctcagcattgtttgctgaactgactgaccagcttgttccagtggctatgatgaaccgcatgagcatgttccatggaacaacagcaagagggtggaaagggatggacccatttttcttcttcatgaatccaagcccagcgtatgaggtaacgttcttgaacaagctgcccctggaacttacttgcagttcggggaaatctagccatgaggtggccaactacatgcagagggtgattgctgccactctttcctatgaatgcactagctttaccaggaaagataagtaccgagcactcgctggaaatgatgggaccgtgcccaaaaaacctctgctatatcccgacaaagtcatgggatgctga

SEQ ID NO: 119 - DNA, 1784 bp, Vitis vinifera
gtttcttttcgttgtccactgtgctgcctgaaaggctgaatccggttctaccggccgagacatgtctccgccaccgaaacgcgcccgaaaatttccctccatcactacctacgccggcggcgaccatcgctctattgcggccgacctcgatggcactctcctcgtctctcgctcctccttcccttacttcatgcttgtcgccgtcgaagccggcagcctcctacgcggtctcttccttctgctctctcttcctatagtgatcgttgcctacctcttcatctcagaagaaatcggaattcagattctcatcttcatttcattttccggcctcaagatccgagacatcgagctcgcgtcgcaggcggtgctgccgcggttctacgccaacgacgtgaggcgagagagctgggaggtgttcgagaagtgcgaacggaaggtggtggtgacggccaacccgacgttgatggttgagccgttcgtgagagattttcttggcggaacgaaggtgttagggacggagattgaggtgaatccgaagacgaagaaggccactggtttcgtgaagaagccaggggtgttggttggagacagaaagagattggcgctgttgaaggagtttggtgatgaattgcctgatatcgggattggtgaccgcgagtctgatcatgatttcatgtccatttgcaaggagggatacatggtgcttccgagtaaatcagctacgccggtgccacccaaccgcctgaaaaccccaataatattccacgatggtcggttcgtccaaccccccacgccactcacggccctcatcatctacctctggcttccatttgggtttgcactctctatcttccgagtctacttcaacctccccctcccagagcgcatcgtccgctacacctacccgatgctgggcatcaaccttgttatccgaggcaaccctcctccgcccccctccccaggttcccccggcaacctctacgtctgcaaccaccgcaccgccttggaccccatcgtcatcgccatcgccctccgccgcaaggtctcctgcgtcacctacagcgtcagccgcctctctcgcttcctctcccccatccccgccgtcgccctcacccgcgaccgcgccgccgacgctgcccgcatctcctccattctccagaagggcgacctcgtggtctgcccagaggggaccacctgccgcgagccctacctcctccggtttagcgcactgttcgcggaactcagcgaccgcatcgtgccggtggcggtgaacgtgaagcagaacatgttccacggcaccaccgtccgaggggtgaagttctgggacgcctatttttacttcatgaaccctcggcccacctatgagataacgtttctggatcggttgccggaggagatgacgtgtaaggccggagggaagtcggccatagaagtggcgaatcacgtgcaaaaggtgttgggtggagtgctggggtttgagtgcactggactgactagaaaggataagtacatgttgctgggaggaaatgatggcaaggtggaatccatgtacaatgccaagaagtgaaaggctgggatcggagaagaaggccacattggaattgtatgggttttagaaaaattacgagggaggtatatcggttaatgtagaattacaacttctatggaaattcccttagtatgattgataattgttgatcatttttcatctggattattcatattatttggacattcaagtttagagttatgaagagtgtcttctgatttctgtggttgatttt

SEQ ID NO: 120 - DNA, 1533 bp, Vitis vinifera
atgaccaaatcaaacctccactctcctcccacctccctaaccatcgatcaatgcacctccatcggccgggaaaaggagacggttgtggcggacatggacggaactcttctcagagggcgcagttcgttcccctactttgcacttgttgccttcgaggttggtgggatttttaggcttcttctgttgttgctatgttctccattggctggagttctctactacttcatatcggagccagctggcattcaggtgctcatattcgcgacctttgtggggatgaaggtttcggatatcgagtcggtggcgcgggcagttttgcccaagttttacgcgagcgacctgcacccggaggcgtggagggtgttctcgtcgtgtgggaagaggtgtgtgctcaccgcgaatccgaggattatggtggaggccttcctgaaggattttttgggtgcagacatggtgttggggacggaggtggacacgtataaagggagagctactgggcttgtccgtggtggtggggttcttgttgggaagagaaaggcagaggccctccgaaatgccttcagcgagacgtctttaccggagattggactcggtgatcgggagacggattatccatttatgagtctctgcaaggagagttacatagttccagcgaagcctgaggtggaggctgttagccatgacaaattgccaaagcccattgtattccacgacggccgcctcgtccaaaaaccaacccctttcatggcgcttctcaccatcctctggatcccagtaggcttcctcttggcctgcttgcgcatcgccgctggtgcgctccttccaatgccgcttgtctactacgccttttgggcactcggtgtcagagtttatatcaagggcaacccccctccaccagccaaaaaatcaataggccaatctggcgtcctcttcatttgctctcacagaaccctcctcgaccctatcttcctctccgccgcattaggccgccctatccctgcagtcacgtactccctttctcgtctctccgaattcatctcccccatcaagacagtccggctcagtcgcgatcgagccaccgacgcagcaatgataaagaagctcttagaggcaggtgacctagccatatgtcccgaaggaaccacttgcagggagccatttctgctaagattttctgccttgttttctgagctaaccgacgagctggtgccggtggctatggcaaaccgcatgaccatgtttcatgggacaacagctagaggttggaaggggatggaccccttttactacttcatgaaccctagccctgcctatgaggtaaacttcttgaataagcttccacatgagctcacttgcggtgctggaaaatcgagccacgacgtcgcgaactacatacagaggatgattgccgcaagtctatcatatgagtgcaccaacttcactaggaaggataagtatcgggcactggccgggaacgatggaactgtagtggaaaagcccaaggttgatgctaataaagtcatgggctgctag

SEQ ID NO: 121 - DNA, 1726 bp, Vitis vinifera
atgggggctcaacgccatttccaaccaatatcgaaatgcagctccgacggtcgagccaatcagacagtggcggcagacttagatggcacgcttcttgtgtcccgaagcgcatttccctacttcatgcttgtggcacttgaagctggtagccttgtgagggcaatcctcctcctagcatcggttccactagtgtatttcatttacttgttcatttcggagtcgctagccattaaaatctttatctatatggcttttgcgggactcaaagttagagagattgagcttgtttcgaggtcagtcctgcccaagttctatgctgaggatgtgcaccccgagagttggagagtgtttaattcctttgggaagaggtatatcattactgccaatcctagaattatggtggaaccctttgtgaagacctatatgggtgccgataaggttcttgggaccgagttggaagtatcgaactccggaagggcgactgggtttgtgaagaaaccaggagttttggttggggaacataagaaagcggcagtgcagcaagaatttggcatgaatttgccagatgtgggcctgggagatagagatacggatcatgatttcatgtccttatgcaaggaaggatacatggtgccaaggacaaaatgtgagccactaccaaggaacaagcttctgagtccagtcatttttcacgagggacgtttggttcagagacccacccctgtggctgccctgttgactttcttatggatgccaattgggatcattctctccatccttagggtctacctcaacattcccttgccagagcgtattgtgaggtacaattacaagatcctgggaatcaagcttattgttaagggtacacctcctcccccgccaaagggaggccaaagtggagtcctcttcgtttgcaaccataggacagttttggaccccgtggtcacggctgtggctttaggcagaaaaatcagctgtgtcacttacagtattagcaaattctcggagctaatttctccaatcaaagccgttgcactatccagggagagagaaaaggatgcagcaaatatcaagcgcttacttgaagaaggtgatttagtaatttgtccggagggaactacatgtagagagccatttctgttgagatttagcgccctttttgctgagctcactgatagaattgtgcctgttgccattaataccaagcagagcgtgttttatggcacgtcaacccggggttataagttgttggatccttacttcgtgttcatgaatccaatgcccacctacgagatcaccttcttgaatcagctgcccgccgagctcacttgcaaaggtgggaaatccccaatcgaagttgcaaattacatccagagggtgctggctggaacccttggctttgagtgcactaacttgaccaggaaggacaaatacgccacacttgccggaacagacggcagtgttccgttcaagaacgaaaaggaaaaggaaaaggcttgagaactgaaagtgattcaaagtaaattaattagtctcatgattttctattgttttacatatattatatgccggaatcattatcatgacaatgaactccgattgtgatgataataaattgttgtgattataaaaataatagtttcttatattgtcgtggagacaagtcaacggtcattttttttaagtttttgaaaataaattttatctggacaagtttcaccttaga

SEQ ID NO: 122 - DNA, 1504 bp, Populus trichocarpa
tcctctctcatggtaatgggggctcatcgccattttgaaccaatagcaaaatgtagcacagagggacgatcaaatcagactgtggctgccgacctggatggaacacttcttgtatcaagaagtgcttttccatacttcttgcttgttgctattgaagctgggagtctcttaagaggactaattctcttagcatcagtcccatttgtatactttacgtacttatttatatcagaggcaatggcaatcaagactttcatcttcattgcctttgcgggacttaaaataagagacattgagcttgtttcaaggtctgtcttgccaaagttttatgctgatgatgttcatccagaaacttggagggtgttcaattcttttggaaaaagatacattgttactgctaatcctaggattatggtcgagccatttgtcaagacctttttaggggctgacaaggttcttggcactgaattagaggctacaaaatctggaagagcaactgggtttatcaagaaacctggagttcttgttggagatcataaaagagatgctctcttaaaagagtttggcacaaatttgcctgatttaggcctgggagaccgcgaaactgaccatgacttcatgtccatttgcaaggaaggatatatggtgccaggaaccaagtgtgagcctctagcaagaaacaagcttctaagccctgtcatattccacgatggccggttagttcaaaggcctactcctttggctgcccttttgaccttcttatggatgccaattggtattattctctccatacttagagtctaccttaacatccctttgcccgagagacttgcctggtacacttataagctactaggaattagagttattgtcaagggtacccctccaccccctccaggaaaaggccacagtggagtcctctttgtttgcaatcatcgtactgtcttagacccagttgtcactgctgttgcactaggaagaaaaattagttgtgtcacctatagcataagcaagttcactgaaattatttcacccattaaagctgttgctttatcaagggagagagacaaagatgctgctaacattaagcgactgcttgaagaaggtgacctggtcatttgccctgaaggaaccacatgtagagagccatttctcttgagatttagtgctctttttgctgagcttactgataggattgtgccagttgctatcaatacaaaacaaagtgtgtttcatggcacgacggttcgagggcacaaactgttggacccttattttgtgttcatgaatccaatgccaacatatgaggtcaccttcttgaatcagctgcccaaagagcttacttgcaaaggaggcaaatcagccattgaagttgcaaattacatacaaagggtgctggctgggacacttggatttgagtgcactaacttgaccaggaaggacaagtatgctaagcttgcaggaacagacggccgtgttctatctaagaaggaaaatgcttgag

SEQ ID NO: 123 - DNA, 1506 bp, Populus trichocarpa
atggttagcttcccaactgttgacaaatgtgcatccatcggcagagaaaagcacagtgtagttgctgacatggatgggaccttgcttagaggccgtagctcattcccttactttgctctacttgccttcgaagctggtgggatttttaggctgcttttcttgctcttgaactcaccactagcaggacttctgtattactttgtgtccgagtctgctggtattaaagttcttatctttgctacatgtgccggaatgaagttatcagatatcgagtctgtagcacgtgctgtgctgccaaagttttactctagtgaccttcattctgagtcgtggcgtgtgttctcttcttgcggaaaacgttgcgttcttactgcaaatccaagaattatggtggaagcatttttgaaagatttcttgggagctgatttggttttggggactgagatattaacttataaaggtagagcaacagggtttgttcagagcccgggagtacttgtggggaagaacaaggcagatgcccttaaaaaggcttttgggaagacacaaccagagattggacttggagatcgtcatacagatgcacccttcatggctctatgcaaggagggctacatagtgccacctaagccagaggttgaagctgtaactactgacaagctcccaaaaccagtcatcttccatgatggccggctagtccaaaaaccaacaccattatcagcactactcataattctctggatccctataggcttcattttagcctgcttgaggattgcagcagggtcactcctgcctatgccaatggtctactatgctttctgggcacttggtgtccgtgtcaacataaagggaaccccacctcccccagccaaaaaatcaattggtcaatctggtgtcctctttgtttgctcacacagaaccttgcttgatcccatatttctctccactgcccttgggcgccctattccagcagttacatactcactttctcgtctctctgaaattatctcaccaatcaaaactgttagactcagccgtgaccgagctgcagacgcatcaatgatcaagaagttattagaagaaggtgacctagctatatgtcccgagcgaactacttgccgcgaaccgtttcttttaaggttctcggctttgtttgctgaattaacagacgaactcgttccagtggctatggcgaatcgcatgagtatgtttcacggaaccactgcaagaggctggaaagggatggatccattttacttcttcatgaaccctagcccagcatatgaagtaactttcctgaacaagttgccactagagctaacattaagtggtgggaaatctagccatgaggtggcaaactacatacaaagagtgattgctgctactctctcctatgaatgcacttcctttactaggagagacaagtacagggcacttgctgggaatgatgggaatgtggttgaaaagacgaaggtccaagccaacaaagtaatggggtgttaa

SEQ ID NO: 124 - DNA, 1506 bp, Populus trichocarpa
atggatagctttccaactgttgacaaatgtgcatccataggtagagaaaagcacactgtggtagctgacatggatggaaccctgcttagaggtcgtagctcattcccttactttgctctacttgcctttgaagctggtgggatttttaggctgattttcttgctattggcctcaccgctagcaggacttctatactactttgtgtccgagtctgctggtattaaggttcttatatttgctacatgtgccggaatgaaggtttccgatattgagtctgtggctcgtgctgtactgcctaagttttactctagcgatcttcattctgagtcgtggcgtgtgttttcttcttgtggaaaacgatgtgttcttactgcaaatccaagaattatggtggaagcatttttgaaagatttcttgggagctgatttggttttggggacagagatgtctacttataaaggtagagcaacagggtttgttcagagcccgggagtacttgtggggaagaacaaggcagatgcccttaaaaaggcttttgggatgacacaaccagagattggacttggagatcgtcatacagatgcacccttcatggctctatgcaaggagggctacatagtgccacctaagccagaggttgaagctgtaactactgacaagctcccaaaaccagtcatcttccatgatggccggctagtccaaaaaccaacaccattatcagcactactcacaattctctggatcccaataggcttcattttagcctgcttgagaattgcagccgggtcactcctgcctatgccaatggtctactatgctttctgggcacttggtgtccgtgtcatcataaagggaaccccacctcccccggccaagaaatcaatcggtcaatctggtgtcctctttatttgctctcaccgaaccttgcttgatccaatatttctctccactgccctcggccgtcctatcccagcagtcacgtactcagtttctcgtctctctgaaattatctcacccatcaaaactgttagactcagccgtgaccgtgctacagacgcatccatgatcaagaagttgttagaagaaggtgacctagctatatgccctgagggaactacttgccgcgaaccctttcttttaaggttctcagctttgtttgctgaattaacagaccaacttgttccagtggctgtggtgaatcgcatgagtatgtttcatgggacaacagcaagagggtggaaagggatggatccgttttacttcttcatgaaccctagcccagcatatgaagtaactttcttgaacaggttaccacaggagctaacctgcactggtgggaaatctagtcatgaggtggcaaactacatacaaagagtgattgctgccaccctgtcctatgaatgcacttcctttactaggagagataagtacagggcacttgctgggaacgatggtactgtggttgaaaaaacgaagctccaagccaacaaagtaatggggtgttga

SEQ ID NO: 125 - DNA, 1797 bp, Populus trichocarpa
acaacataactcacacttcctaagaactctcaaaataaacactatctatccctctccctctccctctctatccccctctgtgatggtcatgggggctcatcgccattttgaaccaatagcaaaatgtagcacagaggggcgatcgaatcagaccgtggctgcagacctagatggaacacttcttgtatcaagaagtgcttttccttacttcttgcttgttgctattgaagctgggagtctcctgagaggactaattcttttatcatcagtcccatttgtgtactttacgtacttaattatatcagaggaaatggcaatcaagaccttcatcttcattgccttcgctggacttaaaataagagacattgagcttgtttcaaggtctgtcttgccaaagttttatgctgatgatgtccatccagaaacttggagggtgttcaattcttttggaaagagatacattgttacagcaaatcctaggattatggtagagccatttgccaagaactttttaggtgctgacaaggttcttggcactgaaatacaggctacaaaatctggaagggcaactgggtttgtgaagaaacctggagttcttgttggagatcataagaggaatgctctcttaaaggagtttggtacaagtttgcctgatttaggcctgggagaccgcgaaactgaccatgacttcatgtccatctgcaaggaaggatatattgtgccaagatccaagtgcgagccactaccaagaaacaagcttctaagccctgtcatattccatgagggccggctggttcaaagacctactcccttggttgcccttctgacgttcttatggatgccaattggtattattctctccgtccttagggtctaccttaacatccctttgcctgagagaattgcctggtacaattataagctgctaggaattagagtagttgttaagggtaatcctccaccccctccaagaaaaggccaaagtggagtcctctttgtttgcaatcaccgtactgtcttagaccctgttgtcactgctgtcgccctaagaagaaaaattagctgtgtcacatacagcataagcaagttcactgagattatttcacctatcaaggctgttgctttatcaagggagagagacagagatgctgcaaatataaagcgtctacttgaagaaggtgacttggtaatttgcccggaaggaaccacttgtagagagccatttctcttgagatttagtgctctttttgcagaacttacagataggattgtgccagtcgctatcaatacaaaacaatctgtcttcaatggcacgacggttcgagggcacaaactgttggacccttattttgtgttcatgaatccaatgccaacatatgagatcaccttcttgaatcagctgcccacagagcttacttgcaaaggaggcaaatcatccattgaagttgcaaattacatacaaagggtgctggctgggacacttggatttgagtgcactaatttgactaggaaggacaagtacgctatccttgcaggaacagacggccgtgttgcaactaagaaggaaaaggcttcagaaaattaatctctccaaaaggcggcataaaagaaaatccatgatttaatttctctattgtttttttttatatataaaatattgctataacaataaaatttgacaatcgctattgtgattaattactataaaataactttagagtatatttgctttttttattttttaagtatgtataccgacatcaaattactctaatgcaatgtttatttaatcttcaa

SEQ ID NO: 126 - DNA, 1575 bp, Sorghum bicolor
atggagcgtcccagcccaacgtgcttagcggcgaacggcccacgtagaaaagcccgaacaatcccgttcccgccgcccccggctgatcttcgtacggggaggttgcggtcgcggcagacggtcgccgccgacctcgacggcacgctgctcctgtcccgaagcgcgttcccgtactacctcctcgtggcgctggaggccggcagcctcctccgcgccgtggcgcttctcatgtccgtgcccttcgtgtacctcacctacgtcaccgtgtccgagaccctggccgtgcgcgcgttcctctacgtcgccgtggcggggctcgacgtgagcgacatcgaggccgtcgcccggaccgtgctccccaggttctacgccggcgacgtccacccggagggctggcgcgtcttccgctcgttcgggaggaggtgcgtcgtcaccgccagcccgcgggtgatggtggagccgttcgccagggcgttccttggcgccgacgtggtcatcgggacggagatggaggtgggcgcgtccgggaaggccacggggttcgtcgccgggcccggggtgctcgtcggcgaacacaagaggcgggcggtggtgagggagttcggcgacgcgctgccggacgtcggcatgggggatcgcgagagcgacttcgacttcatggccatctgcaaggaagcgtacatggtaacacggcagaagtaccgcgcgttgccccgggagcagctgcagagccgggtcatcctccacgacggccgcctggcccggcgaccgacggcgaccaacacgcttctcactctcctgtggatgccgctcggcttcgcgctcgcgctggcgcgcgtgcatctccacctgctcctcccggcgcgcgccctctcctacgcctacaagcttatgggcgtcaagctggtggtgcgcggcaaccggccgccgccgccgccgccgtccaagaagggcggcggccccggggttctcttcgtgtgcaaccaccgcaccacgctcgaccctgtcgcggtggccgtcgcgctgggccgcaaggtgagatgggtcgtcacggacggcgcctccagcaggttctcggaggccgtgtcgcctgtcatgacaggcgtggcgctgcccgtgcccgtgcccagccgcgagagcgacgacgacgcggacgccgccgcccgcatccggcggctgctcgaggagggagacgacgtcgtcatcttccccgagggcaccatctgccgcgagcccttcctgctgcggttcggcgcgctcttcgctgaggtcaccgaccgcatcgtgcccgtggccatcggcgctagggagggcatgttccacgggtccacggcgcgcgggctcaggagaatggatccctacttctttttcatgaacccacggccgacgtacgaggtgacgttcctgaaccagcttccaagggagctcacctgcggcggcggaaggtcgccggtcgaggtggccaactatgtccaggaggtcctggccgcgcagcttggattcgactgcacttgcaccagcaagcaggcaaaaacaggatggtctccggcggccccgacggttgcgtggcgttga

SEQ ID NO: 127 - DNA, 1967 bp, Sorghum bicolor
gcctcccatatccatactcccccgcgcccgtcaccaccaacctcccgtcgcgtatattataactacacctcgccgccccactctccactgccaactcgcagcagcagtctctcctctgctcccacacactccttccccggggcctggcagtgagatcgagcctcgatccatcgagcactatagtagcaaagacacaagatggtggcgtcgtatcgcagtcgcaggttcaagcccatcgaggagtgctgctcggaggggcggtcggagcagacggtggccgccgacctggacggcacgctgctcatctcccggagcgcgttcccctactacctcctcgtggcgctcgaggccgggagcgtcctccgcgccgtgctgctgctcctgtccgtgcctttcgtctacgtcacctacatcttcttctccgagtcgctggccatcagcacgctcgtctacatctccgtcgcggggctcaaggtgcgcagcatcgagatggtggcgcgctccgtgctccccaggttctacgctggcgacgtgcacccggagagctggagggtgttcaactccttcggcaagcgctacatcatcaccgccagccccaggatcatggtcgagcccttcgccagggccttcctcggcgccgacaaggtcgtcgggaccgagctcgaggtcggcaagaacggcaaggccacggggttcatggtcaagcccggcgtgctcgtcggcgaccacaagaagaaggccgtcgtcaaggagctgggcgacgccgtgcccgacgtcggcatgggggatagggagaccgacttcgacttcatgtccatctgcaaggaggcgtacctggtgacgtcgaggaagtacagcccggtgggcaagaaccagctgctgagcccgctgatcctacacgacggtcgcctggtgcagcgcccgacgccgctcgtcgcgctcgtcaccttcctctggatgccgttcggcttcgcgctcgcgctcatgcgcgtgtacatcaacctgccgctgcccgagcgcatcgtctactacacctacaagctcatgggcatcaggctgatcgtcaagggcaacccgccgccgccgcccaagaagggccacccgggcgtcctcttcgtctgcaaccaccgcaccgtgctcgaccccgtcgaggtcgccgtggcgctgcgccgcaaggtcagctgcgtgacctacagcatctccaagttctccgagctcatctcgcccatcaaggccgtcgcgctgtcgcgggagcgagagaaggacgccgagaacatccgccgcctgctggaggaaggcgacctggtgatctgccccgagggcaccacctgccgcgagcccttcctgctgcggttcagcgcgctcttcgccgagctcaccgaccgcatcgtgccggtggcgatcaacaccaaggagagcatgttccacggctccaccgtgcgcgggttcaagctcatggacccttacttcttcttcatgaacccgcggccgacgtacgagatcacgttcctgacccagctccccaaggacctcacatgcagcggcggcaagtcgcccatcgaggtggccaactacatccagaagacgctcagcggacagcttggcttcgagtgcaccaccatcacgcgcaaggagaagtacggcatactcgctggaacggacggccgtgtcccgtccaagaacaaggacaaggagaaggagaagaactaacggccaacgtcgtcatcgctgctgcccgcccagcacactgccgttacgagtactgctgaaatttattccaattaattgttccttgtcgagaagttggccaattactcattgtttttaaaaggaccatgtgatgtgggccgtgtactagtacaagcttgatgatcatataattattatctacaagttcttcctcttcggaagaagggcaaaagtgttgttaggcccgtcttaatacaaagtttcgttgcatagtttcc

SEQ ID NO: 128 - DNA, 1518 bp, Sorghum bicolor
atggctgcctcgccgttccccacggtggagaagtgctcctccaccgaccggtccggcgacacggtggtggcggacctggacggcacgctgctgtgcggccggagctccttcccgtacttcgcgcacatggcgttcgagaccggcggcgtgctgcgcctgctgctgctcatcgcgctggcgccgctcgcgggcctcctctactacttcgtgtccgagccggcgggcatccaggtgctcatcttcgcgtccatggcgggggccagggtggccgacatcgaggccgtggcgcgggcggtgctgcccaagttctactgcgccgacctccacccggagtcgtggcgcgtcttctcggcgtgcggccgccggtgcgtgctcaccgcgaacccgcggatcatggtggaggcgttcctcaaggagtacgtcggcacggacgtcgtcgtcggcacggagctcgtcgtgtggcgaggccgcgcgacggggctggtgcgctccccgggcgtcctggtcggcgagcagaaggcggacgcgctccggaggacgttcggcgacgacgtcgcgcccgaggtcggcctcggcgacaggaagacggactacccgttcatgaggctgtgcaaggagggctacgtcgtgccggcgacgcccaagctgaagcccgtgccgcgcgagaacctgccgaagccggtggtcttccacgacgggcggctcgtccagaagccgtccccggcgctcgcgctgctcaccgtgctctggatcccgatcgggttcctgctcgcgtgcctgcgcatcgccgcgggcgcgctcctgccgatgcgcatggtgtaccacgcgttccgcgccctcggcgtccgtgtcaccatcaggggaaaccctccgccgccggcaagccgcgagacgggccagaccggcgtgctcttcatctgctcccaccgcaccctcctcgaccccatcttcctctccaccgccctgggccgccccatcaccgccgtcacctactcggtctcgcggctgtcggaaattctgtcgccaatccgcacggtgcgcctgacccgagaccgcgcggcggacgcggccatgatccggcggctcctgaccgagggagacctggtgatctgcccggaggggacgacgtgccgggagccgttcctgctgcgtttctcggcgctgttcgcggagctgacggacgagatcgtgccggtggcgatggagaaccagatgagcatgttccacgggacgacggcgcgagggtggaaagggctggaccctttctacttcttcatgaacccgagccccgggtacgtggtcacgttcctcaacaagctcccagcagagctcacctgcaatggcggcggcaagagcagccacgaggtggccaactacatccagcggctcatcgcgtccacgctgtcctacgagtgcaccaacttcacacggaaggacaagtacaaggcgctcgctggcaacgacggcaccgtcgtgtccaagcccaacattgacaagaacaaggtcatgggctgctag

SEQ ID NO: 129 - DNA, 1776 bp, Sorghum bicolor
gcagtgcgcagtgcgagagagagacagagtgagtgacagctccgatccgccgcacacgcgcgtgccacagcagatagcagcgagccatccatcccggcggccggcatggaggaggcggtggaggctgtggttgccgccggagtggagccgttcccgacggtggacaagtgcgacgcctcgggcctcggcgcgcactcctccgtggtggcggaccttgacggcacgctgctccggtcccgcagcgcgttcccgtactacgcgctggtggccttcgagaccggcggcgtgccacgcctgctcctcctcctgctcctctccccgctggccgccttgctgcgcttcctggcgtcggagtccgcgtgcctgcgcgtgctggtgttcggtgccacggcgggcgcccgtgtccgcgacgtcgagtccgcggcgcgcgccgtgctccccaggttctacgccgccgacgtgcacccggcggcctggcgcgtcttctccgcgtgctcccggaggcgcgtcgtgctcacggccacgcccaggctcttcgccgagccgttcctcagggactgcctcggcgccgacgccgtcgcgggcaccgagctcgccacgtggcgcggacgcgccacgggcttggtggacgcgcgcaggggcggcgtcctcgtcggcaggagcaaggcccaggcgctgcgggagatcttggccgccgacggcggcgacgcgcccgacgtcggactcggggacagccgctccgactaccccttcatgagcatgtgcaaggaggcgtacatcgtaccgcgcgcgccggtggagccggcattgcccatggaccagctgcctcgtccggtcatcttccacgacgggcgcctggtgcgccggccgacgccgctggtggcgctggtggtggtgctgtggttccccgtggggcttgcgctggcctgcctccgcatcgcggcgggggcgctgctgcccatgccgctggtgtactacgccttctgggcgctgggcgtgcgcgtcgtggtgcggggcgcgccgccgccgccgcgcgccgagcgcgccacggggcggaggggcgtcctcttcgcctgctcgcaccggacgctgctggaccccatcttcctgtccacggcgctgggccgccccgtcgccgccgtcacctactcgctctccaggctctccgagttcctgtcgcccatccggacggtgcgcctgtcgcgggaccgcgccacggacgccgccatgatcagggacctgctggcggagggagacctggtcatctgccccgaggggaccacgtgccgggagcccttcctgctgcgcttctcggcgctcttcgccgagctcaccagcgaggtggtgcccgtcgccatggagaacaggatgagcatgttccacggcaccaccgccagggggtggaaagggatggaccccttctacttcttcatgaacccgagcccggcctacgtcgtcaccttcctcaacaagctcccgccggagctcacctgcgccggcggcaggaccagccacgaggtggccaactacatccagaggctcatcgccgccacgctctcctacgagtgcacaagcctcaccaggaaggacaagtaccgggcgcttgcaggcaacgacggagtcgtcgccaccccaaagccgccgccaacggttgctagctagctagctaaggttattattattattattttttttaaaaaaaaagagagagaaagaaaattgggttattatattgtggtgatgatgctactgaattcattgtgattgttatgatgc

SEQ ID NO: 130 - DNA, 1744 bp, Ricinus communis
catttataacattttcagagagagagagagagagagtaatataaatatgccggcgatgaaacaggctcaaaagtttccgtcaataacatcatgcagcggcacctcatacgaatcaatagcagctgatctggatggtactctgctcgtctccagtagctcctttccttacttcatgctcgtggccgtggaagccggtagtctgttgcgtggtctagtgttgctgctttcgctgccttttatcatcatctcttatttcttcatatcagaagccatcgggatccaaatcctaatcttcatctctttcgctggtctcaaaatccgtgacatcgagcttgtttcccgcgctgttctgcctagattttatgctgcggatgtgaggaaagaaagctacgaggtgttcgataggtgcaagaggaaagtggtggtgacggcgaatccgacgattatggtggagccgtttgtgaaggattttcttggcggagacaaagttttgggaacggagattgaagtaaatcctaagacaaagagggccactggtttcgtgaagaagcctggcgtgttggttggcaaatggaagaagttggccattttgaaagagtttggagaggacgctcctgatcttgggatcggagaccgcaagactgatcatgacttcatgtccatttgcaaggagggctacatggtttatcacagcaaaaaagcagctactccactgccacgggatcgcctgaaaagtcctataatcttccacgatggccgttttgttcaacgaccggacccactcaatgccctcgctacctatctttggttgccatttggattcatgctctccatctttcgggtatacttcaatctaccactccccgaacgcatcgtacggtacacatacgagatgttaggcatccaccttgtgatccgtgggtacccacctccagcgccatcacgtggaacccctggaaatctatatgtgtgcaaccaccgtacagctttggatcctatcgtgattgcaatcgcactcggacgcaaagtttcgtgtgtaacatacagcgttagccgtctctcgagattcctatcaccaatcccagccatcgctttgacacgtgatcgtgcggctgacgcagaacgcatcacagctctactccaaaagggtgatcttgtagtgtgtcctgagggaactacatgtcgcgagcagtttttgttgagattcagtgcactgtttgctgaaatgagcgataggattgtgcctgtggcggttaattgcaagcaaagtatgttctatggcaccactgtacgtggggttaaattttgggacccttattttttctttatgaatccaaggccaacttatgaggtgacatttcttgatcggttacccgaagagatgacggttaaagcgggagggaaatcatcgattgaggtggctaattatgtgcagaaggttttgggtgatgtgttggggtttcagtgtactggattaacgaggaaggataagtacttgttgcttggagggaatgatggcaaggtggagtctatgtacaactccaaaaagtaagcatttggtttttcgtttctataagatttttagttacggatgtttgtaaggccagacatatcaaatattttagacattgatgtcgtcgtgctgaatttgcgcacagctttatatgcaagactcttttaagaatttggatgtccgatttcatggacgtgactggttaagatttcatgatgttataagggaatt

SEQ ID NO: 131 - DNA, 1539 bp, Ricinus communis
atggcaaaccctaaagaaacatatgctccttttagctcattcccaaatatagaaaagtgcacatccgtaggtcgacaaaacgacactgtagtgaccgatatggatggaaccctactttgtggacgtagcccgtttccttactttgccttagttgcctatgaagctagtggaatattaaggcttctattcttgctattaggttcgcctattgctggaattctccgctacttcatctccgaatctgctggaatccgagtacttgtatttgcaacctttgcagggatgcgagtgtctgatatagaatcggtggcaagagctgttttgcccaagttttattctagtgacttgcacccagagacttggcgggtgttctcttcgtgtgggaagaagtgcgtaatcacggaaaatcctaggattatggtagaggcattcttgaaagagtttgttggggctgatatggttattggcactgagattgttgtgcataaagggagagcgactgggtttattaggagtcccggtgttcttgttggacagaacaaggctgatgcgctaaaaatggctttctatgatgcgccggtgccaaatattgggatcggtgacaggaggactgatcgtccattcatgaaattgtgcaaggagagctacatagtcccaagcaattctcaagtagagccagttggtcctaaaaagttaccaaaacccatagttttccatgacgggcggcttgtccaaaaaccaacacatttaatcgcgcttgctactcttctttggattccagtaggctttattctcgcctgtctacgcttagccgccggtgcgctccttccaatgccattagtgtactacgccttgtgggcacttggtgttcgtattcacataaaaggcacaccaccgccgccagccaagaaatccactggccaagctggagtcctcttcgtatgttcccatagaactcttcttgacccggtcttcctctccatcgctttaggacgtccaatcccagccgtcacttactccctttcgcggctatcggagttcatttcacccatcaagactgtcaggctcactcgagaccgcgttactgatgcaaacatgatcaaggaactattacaagaaggtgacttagtcatatgtcctgaagggactacttgtagggaaccatttttgcttcggttttcagctttgttcgcggagttaaccgatgaacttgtccctgtcgccatggctaataagatgactatgtttcatggaacaacagctagaggatggaaagggatggaccccttctatttcttgatgaaccctagccctgcatatgaagtgacatttttgaacaagttgccttacaatttaacatgcggagcaggaaaatctagccatagtgttgctaattatatacaaaggacgattgctgcaactttgtcttaccaatgcaccagctttactaggaaggataaatatagagcacttgctggcaatgacggaactgtcgtggaggagcccaagcaggctcgtgatgaagtcatggattcctag

SEQ ID NO: 132 - DNA, 1515 bp, Ricinus communis
atggttatggtggacagcttcccagaagttagcaaatgtgcgtccaaaggccgagaaaagcacacggtggtcgctgatatggatggcaccctgtttattggtcgtagctccttcccttatttcgctctaattgccttcgaggctggtgggatttttaggcttcttttcttgctcttggcatcaccacttgcggcacttctttattactttgtttcagagtctgctggtattcaagttcttatctttgcatcctttgctggtatgaaagtatcggatattgaatctgtagcacgcgcagtgctgccaaagttctactccagcgatctccatcctgagtcatggcgtgtgttctcttcttgtgggaaacgctgcgttcttacagcgaacccaagaattatggtggaagcatttctgaaggatttcttgggagctgatttagtttttggtactgaaatatcaacttataaaggtagagctacaggttttgttcgtacccctggtgtacttgtaggcaagaacaaggcaaatgctcttaaaaaggcttttggagacgcaaggccagaagttgggcttggagataggcgcactgatgctccctttatggctttgtgcaaggagggatacctggtgccacccaagccggaagtcagggcagtaacaggtgacaagctcccaaaacccatcgtcttccatgatggcaggctagtccagaaaccaacaccattaatggcacttctcatcattctctggataccaataggcttcattctagcttgcttgagaattgcagcaggatcactcctgcctatgccaatggtctactatgccttcttagcactcggtgtccgtgtcacagtaaaaggcaacccacctcctccagccaagaaatcaactggtcaatcaggtgtcctctttgtttgctcccacagaactctccttgaccccatattcctctccactgcccttggccgccctattgccgcagtcacatactcagtatctcgcctctcggaaattatatcacccatcaaaacagttaggctcagccgcgatagagcaacagatgcagcaatgatcaagaagttgttagtagaaggtgacttagcgatatgtcctgaagggaccacttgcagggaaccctttcttttaaggttttcagctttgttcgcagaattaaccgatcaaattgtgccggtagctatggtgaacagaatgagcatgttccatggaactaccgctagagggtggaaagggatggatccattttacttcttcatgaaccctagtccagcttatgaagtaactttcttgagtaagttgccccaagaattaacgtgcagttcaggcaagtctagccacgaagtggctaattacatacaaagggtgattgctgctactctttcctatgaatgcactggatttactagaaaagataagtacagagcacttgctggcaacgatggcagtgttgttgagaaacctaagctcgaagccaacaaagtaatgggttgctaa

SEQ ID NO: 133 - DNA, 1804 bp, Arabidopsis lyrata
tttgtgctctctgttctttagagccgccattaacgagagagagagagagagagagagacttggcgagttataatgtctcccgcgaagaagagtggaaactttcctccgataacggaatgcagagacggagagtacgattcgatagccgccgatcttgacgggactctgcttctctcaagaagctcgttcccttacttcatgctggtcgccgttgaagctggaagccttttccgtggactaatactgcttctctcattaccaatcgtcattatttcttacctattcgtatccgaatctcttggaatccagatcctcatcttcatctccttcgctggtctcaaaatccgcgatatcgaactcgtctctcgcgcagttcttccacggttttatgcggcggatgtgaggaaagacagttttgatgtgtttgataagtgtaagaggaaagtggtagtgacggcgaatccgatagtgatggtggaggcgtttgtgaaggattatcttggaggtgataaagttttgggaacagagattgaagttaaccctaaatccaatagagccactggatttgtgaagaagcctggtgttcttgttggtgatcttaagaggttagccattttgaaagagtttggtgacgaatcacctgatctcggcctcggtgatcgaacctctgatcacgatttcatgtccctctgcaagaaaggttacatggttcatgcgtgcaagtcagccacaacaattccaaaagaacgtttaaagaaccgcatagtcttccacgacgggcgtttagcgcaacgtccaacgcccttaaacgccattgtcacatacctatggcttccctttggtttcatactctccatcattcgcgtctacttcaacctccctttacctgaacgctttgtccgttacacctacgagattctcggaattcacttaaccattcgtggccatcgtcctccacctccttcccccggaactcttggcaacctctatgtccttaaccaccgtaccgcgcttgatcccatcatcgttgctattgctcttggacgcaagatctgttgtgttacttacagtgtctctcgtctctcccttatgctttctcctattcctgctgttgccctcacccgtgaccgtgtcaccgatgctgccaacatgagaaaacttctcgagaaaggcgacttggtgatatgtccggaaggcacaacgtgcagagaagagtatctactgagatttagcgctctattctcagagctaagtgaccggattgtgccagtagcgatgaactgtaaacaaggaatgttcaacgggaccacagtgaggggtgtgaagttctgggacccttacttctttttcatgaacccaagaccaagctatgaagccactttcttggatcgtttgcctgaagaaatgactgtcaacggtggcggcaagactcctatagaggtggccaattacgtccagaaagttatcggcgcggtcttgggcttcgaatgcaccgaacttactcgcaaggataaatatcttttgcttggaggtaatgacggcaaggtggagtctatcatgttgggataaacttgaaataacttaagagataagttactaaaatgtaaaagagataaagctgaatattctaggagttatctagaataaatgtattaggagttttaattgatgatgtattggtacgttattgttatgttaattctatttttccctaaaactattttgtgatcacatttctatacgcatgtgcttaagggataataagaactttatatttaaagagcaaaattttattggaggaagt

SEQ ID NO: 134 - DNA, 1746 bp, Arabidopsis lyrata
atatccattctcaccttccaaatctctctcttctcttctctttccggcttcttcactaatgggagctcaggagaaacgacgtcgtttcgagcctatatcaaagtgcgacgttaaggaccggtccaaccataccgtggccgctgatctagacgggacactactgatctcacgtagcgccttcccttactatttcctcgtagccctcgaggcagggggcttgctccgagcattgatcctactcgtgtccgtaccgttcgtctatcttacgtacttgaccgtctcggagactttggccatcaacgtttttgtcttcatcacgtttgcgggtctcaagatccgagacgttgagctagtggtccgttccgtcctcccgaggttctatgcggaggacgtgaggcccgatacgtggcgtatctttaacacgtttgggaaacggtacatagtaacggcgagtcctcgaatcatggtcgagccgttcgtgaagacatacctaggagttgataaagttctcggaacagaactagaggtctccaaatcgggtcgggcaaccgggttcaccagaaaacccggtattctcgtgggtcagcacaaacgtgaagtcgttttgagagagtttggtagccttgcgtctgatttacctgatttggggctcggcgatagcaagacagactacgacttcatgtccatctgcaaggaaggttacatggtgccacgtacgaaatgcgaacccttaccaagaaacaaactcttaagccccataatattccacgagggcagattagtccaacgcccaacgccgttagttgctctgttaactctcctttggcttcccatcggtttcctcctctctcttatccgcgtctacacgaatattccgttaccggaacgtatcgcccgttacaactacaagctcactggcatcaagctaatcgtcaacggtcaccctcctccgccgccaaaacctggccaaccaggccatctcttggtttgtaaccaccgcaccgtccttgacccggtggtgacagccgtcgcgctcggccggaaaatcagctgcgtcacttatagcattagcaagttctctgagctaatctcaccaatcaaagccgttgcgttgactcgtcaacgtgagaaagacgcagcgaacatcaagcgccttttggaagaaggcgatcttgtgatctgtcccgagggaactacgtgccgtgagcctttccttctccggtttagtgccctcttcgctgagctcacggaccggattgttcccgtggcgatcaacacgaagcagagcatgttcaatggtactaccacacgtggctacaagcttcttgatccttacttcgcgttcatgaacccgaggccgacgtacgagatcacgttcctcaaacagattcccgctgagctgacgtgtaaaggaggcaaatcgccgatagaggtggcgaattacatacaaagggttttgggaggaaccttaggttttgagtgcaccaatttcacaagaaaggataagtacgcaatgcttgctggtaccgacggtagggttccggtgaagaaggagaagacgtgattattgatcggagaatggagaaaacgaagaaataatacaaagattggaatcttttttcatttggatggttaattatcaatatttaaggggcaaagaattgataagtttatttttttgttgtttcctttatcttctctgcttcgatgaatgtttcaagatttacttttagtacaataacggtt

SEQ ID NO: 135 - DNA, 1509 bp, Vernicia fordii
atgtcgcaaacgaaaccggctccaaaattcccttcaataacatcatgtaccggctcggcgtatcagtcaatagcggctgatcttgatggcacgctcctcgtgtccagtagctccttcccttacttcatgttagtggctgtcgaagctggtagtctcctccgtggtctggtgtcgcttctgtctctacctcttgtgatcatctcctattttttcatatctgaagccgtcggaatccaaatcctaatctatatctcctttgctgggctcaagatccgcgacatcgagctggtttcccgcgctgttttgcctaggttttatgctgctgatgtgaggaaggagagttttgaggtttttgacaaatgcaagaggaaggtggtggtgacggcaaatccgacgattatggtggagccatttgtgaaggattttcttggcggagacaaggtgttaggtacggagattgaagtaaatccaaagactaagagggccaccggattcgtgaagaatcctggcgtgttagtggggaaatggaagaaattgtccattttgaaagagtttggagaggaatcaccggatcttgggatcggagaccgcaagacggatcatgatttcatgtccatttgcaaggagggctacatggttcaacgcagcaaatcagctactccaataccactggatcgtctcaaaagtcgtataattttccatgatggccggttcgttcagcgacctgacccactgaacgctcttgtcacctatctttggctgccatttggattcatcctctctattattcgcgtatacttcaatctcccactcccagaacgcatcgtacggtacacatacgagatgctaggcatccaccttgtgatccgtgggaacccgcctcctgccccatcacctggaaccccaggaaatctctatgtttgcaaccaccgctcagctttggatcctattgtcattgcaatagcacttggacgcaaagtttcctgtgtaacatacagcgtaagccgtctctcgaggttcctatctccgattccagctatcgctttgactcgtgatcgtgccgctgatgcagcacgcatctcagagctactccaaaagggtgatcttgtagtgtgtccagaggggactacgtgtcgcgagccgttcctgttgcgattcagtgcattgttcgcagaaatgagcgataggattgtgccggtggcggttaactgtaagcaaaatatgttctatggtaccaccgtacgtggtgtcaagttttgggatccttattacttcttcatgaacccaagaccaacctatgaggtgacattccttgatcggttgccggaagagatgacagctaaggcgggagggaaatcgtcgatcgaggtggctaattatgtgcagaaggtgttgggtgatgtgttgggattcgaatgcactggattaactagaaaggataagtatatgttgctaggaggaaatgatggcaaggtggagtcaatgtacaacaccaaaaaagccggttaa

SEQ ID NO: 136 - DNA, 1545 bp, Oryza sativa
atgggggacgccacgatgatcgcgtcgccgttcccggcggtggagaagtgttcgtccaaggaccgcggcggcgacacgatcgtcgccgacctcgacggcacgctgctgtgcggccggagctcgttcccgtacttcgcgcacatggcgttcgagacggggggcgtcctccggctgctggcgctgatcctgctggcgccgctcgccggcgtgctctactacctggtgtccgagtcggccggcatccaggtgctcatcttcgcgtccatggccggcgcgagggtcgccgacgttgaggcggtggcgcgcgccgtgctgcccaagttctactgctccgacatccacccggagtcgtggcgcgtgttctcggcgtgcgggcgccggtgcgtgctcaccgcgaacccgaggatgatggtggaggcgttcttgaaggagtacctcggcgccgacatcgtcgtgggcacggagctcgtggtctggcgtggccgcgccacggggctcgtccggagccccggcgtgctcgtcggcgagaacaaggcggccgcgctccgggaggcgttcggcgacgcctcgccggagatcggcatcggcgaccggaggacggactacccgttcatgaggctatgcaaggaggggtacgtggtgccggtgtcgccgacgccgaggcccgtgccgcgggaggagctcccgaagccggtggtgttccacgacggccgcctggtccagaagccgtcgccggcgctcgcgctgctcaccgtgctctggatccccatcggcttcgtgctcgcctgcctccgcatcgccgccggcgcgctcctcccgatgcgcgtggtgtaccacgccttccgcgccctcggcgtgcgcgtcaccgtcaagggcaccccgccgccaccggccagccgcgagaccggccagtccggcgtgctcttcatctgctcccaccgcaccctcctcgaccccatcttcctctccaccgccctcggccgccccatcaccgccgtcacctactcggtgtcgcggctgtcggagatattgtcgccgatcaggacggtgcggctgacgcgggacagggcggcggacgcggcgatgatccggcggctgctggcggagggcgacctggtgatctgcccggaggggacgacgtgccgggagccgttcctcctccggttctcggcgctgttcgcggagctcaccgacgagatcgtgccggtggcgatggagaaccagatgagcatgttccacggcacgacggcgagggggtggaaggcgctggaccccttctacttcttcatgaaccctagccccggatacgtggtcaccttcctcagcaagctccccggcgagctcacctgcaacggcggtggcggcggcggcggcggccggagcagccacgaggtggccaactacatccagaggctcatcgcctccacgctctcctacgagtgcaccagcttcaccaggaaggacaagtacagggcgctcgccggcaacgacggcaccgtcgtgtccaagcccaacatcgacgagaagaaggccatgggatgttaa

SEQ ID NO: 137 - DNA, 3343 bp, Brassica napus
aaattaaacaaatttgatagaatatacattttttttatcagatctttattattcaaaatcattaattgtcatatatactttatccacattaggcaattccgtaatctttatttaaggaaataataaatgacattaataatgaatttatggttagtttaataaaaaaacttattatataattagatgaccaacctatttctctaataattctaagaatcatcctagtgataacatgtgtctacaaaaagaagttgtaatgtttcacaaataatatacaggggatcagttattttcatcaacatagttggatacacagctgtatagacattaattggtaaagctatacatagccaaagtatattaatgagtcactcaactaatgagacggccttctatttaggtgagctggtaagctacttcctttcatgtcgatcaacaaaaaataaataaggcttttcttttagtcctaactccgaagagaaccgcgtgacctaaactatagtatttattacacatattgatccacgattgatagataatattcaccacttttcattatatttacatactaatgcaaacctatgtagtaaaattaatcacatattgaattatgacttataaaatgtaatcgtataacaaaaagatggatggtttaagccaaagactttgttacgactcttgtaatggggaatttatatatttaagtgagaatgatgacaaagtgagaaagaatcaggttataattgttagaaatgatagtttaaggataaatttgtaaagaagtcatattggataaggagtgacaatattataaatcggtaaggaatgcagcgcatttaaaacaagaaagaccccttccctctctttctttccaagattctctctctctgtttaccatcaaagagagatcgaaaaatgtctccggcaaagaagaagagcagaagctttcctccgataagcgagtgtaaacgtggagagtatgattcgatcgccgcagatctcgacgggactatgctcctctcgagaagctccttcccttatttcatgctcgtcgccatagaagcaggcagcctcttccgtggattgatcctccttctatctctcccgatcgtcatcatcgcctacctcttcgtctccgaagctctcggcatccaaatcctcatctacatctccttcgccggcatcaaaatccgcgacatcgagctcgtctcccgcgccgttcttccacggttctacgcggcggatgtgaggaaggacagtttcgaggtgtttgataaatgcaagaggaaagtggtggtcactgctaatcccatagtgatggttgagcctttcgtcaaggattacttgggaggagataaagttttgggaacagagatcgaagtgaatcccaaaacgatgaaagccacggggtttgtgaagaagcctggtgttcttgttggagacttgaagagattagccatcttgaaggagttcggggaagaatcaccggatcttggcctcggtgaccgcacctccgatcatgatttcatgtccatttgcaaggtactataaacatatacgtttaagtttcttgaatttttaagaaccccggtttaggtgaaaatcgagtgcataaacgtctgatactttgaaacatttcgtaatcaaagaagtaagtacttgaaaactacacataaatgcagtaggacctatttaatgccgtgttgcgtgttcacatgccttcacatgatctattcacttttttttacgtccaaattatttgtatgtgtgtgtatgtataataaaaacacgcatgaaatatctagattaagtagttttgttatttgaattcaagaaaggaacgtaataagtttccggtgacaaaaaaatgtagataatagaatagaatagtagtagtgattttcataaatgcttcctaccttatcaccaaccgcccatccccacataagttgaatggtcccatttaatgaccgaacccatatgtcaacattcctttctttctttttctcctaaccactgaaactttcagtaatttacgagctttcttactataattgtgtaactttggaatcttttactacatgattggtaacgacttgcttttctcttgtaacaggaaggttacatggtgcatgagtccaaatcagccacaacagtccccatagaacgtctcaagaaccgtataatcttccacgacggccgtctagtccaacgccctacgccgttaaacgccataatcatttacctttggcttcctttcggtttcatgctctctatcttccgcgtttacttcaacctccctttacccgaacgcttcgttcgctatacttacgagatcctcggtattcacctaactatccgtggccaccgtcctcctcctccttccccaggcacacctggaaacctctacgtccttaaccaccgtactgctcttgaccccattatcatcgccattgctctcggccgtaagatctcttgcgtcacttatagtgtctctcgcctctcccggatgctctcacccatccctgccgtcgctcttacccgagaccgcgccgctgatgctgctcgcatgagaaaactcctcgagaaaggtgacatcaacccttgttactatcattctatatcattggtttcatcatctcatgagttccaatatgaaaataatataggttttgaaagccttcagtcaaaaaataaaaatattgtaggtttccatgtcacggttacttttaagaatcaactgcataactagaaaacataaaacatagcatctttgtgtgttttctatacatattatcacgctaggcacaaaagatagttggagaatcagatagcgttcgtctatataaaagtgggaaacagagcatctatgtttactagatataaggtccatcacataagtcttttattatttttgtaacaggtgatttggtgatctgccctgaaggcaccacttgtagagaaccgtatctactacgatttagcgctctatttgcagagctcagcgaccggatcgtgcccgtggccatgaactgcaagcaagggatgttcaacggaaccacagtacgaggtgtaaaattctgggacccttacttcttcttcatgaacccgagacctagctacgaggccactttcttggaccgtttgcctgaagaatggacagtaaacggcggcggtaaaactccaatagaggtggcaaattacgttcagaaggtgatcggtggagtattgggattcgagtgcactgagctcacaaggaaggataagtatcttttgcttggaggcaacgacgggaaggttgagtctatcaataagagcaaggccaaggagtaataaatccagc

SEQ ID NO: 138 - DNA, 1503 bp, Populus trichocarpa
atgtcgccaacgaaacccgcaaaaaaatttccgccgataacggcctgtaacggcacgacgcaccaatctatagcagcggatcttgatggcacactccttgtgtcgagtagctcgtttccatactttatgattgttgctgttgaagctggaagcctctttcgtggtcttgttttacttctttcactgcctatcgtcatcgtgtcttacctcttcatatctgaagccttggggatacaaatgttaatcttcatttctatgtctgggctcaagatccgtgatattgaacttgtttcacgcgctgtattgcctaggttttatgctgcagatgttagatcggagagttttgaggtgtttgataggtgcaagagaaaggtggtggtgacagcaaatccaactataatggttgagccttttgtgaaggattttctcggtggagataaggttttgggcacggagattgaagtgaacccgaagaccaagagggctacaggatttgttaagaagcctggtgttctggtgggcaagtggaaagaattggctgttttaaaggagtttggagaggaagcaccggatcttggtattggtgaccgcaagactgatcatgatttcatgtccctttgcaaggagggctacatggtgcatcgcagcaaatcagcgactccactaccgcgggatcgcctcaaaaatcgtatcatcttccatgatggccgtcttgttcaacgtccagacccactcaatgccttgatcacttacatttggttgccgtttggattcatcctctccatcattcgcgtctacttcaacctcccactcccagaacgcatcgtacggtacacatacgaaatgcttggcattcacctggtcattcgtgggaccccacctcctgccccatcacctgggaccccaggaaatctctatgtttgcaatcaccgtacagccctggatccaattgtcatagccatagcacttggacgcaaagtctcgtgtgttacgtacagcgtaagccgtctctcgaggtttctttcaccaatcccagccatcgctttgactcgtgatcgcgcggctgatgctgcaagaatatcatccatacttcaaaagggtgatctagtggtgtgtccggagggaaccacttgtcgtgaggagttcttgctgcgatttagtgcattgtttgcagagttgagtgataggattgtgcccgtggcagtcaattgtaaacaaaacatgttttatggcacgaccgtgcgtggtgtcaagttctgggatccttattttttcttcatgaacccgaggccaacttacgaagtgacattccttgatcgcttgccagaggaaatgacggtcaaggctggtggcaaatcttcgatcgaggtggcaaactatgtgcagaaagtgttgggtgaagtgttaggattcgagaacactgggttgaccaggaaggacaagtacctgttgcttggtgggaatgatggtaaggtcgagtcaatgcacaatgccaaaaaataa

SEQ ID NO: 139 - DNA, 2117 bp, Sorghum bicolor
gccgagctcgactcggaatccgatcccccacccaactccatgctccgattcctcctcccttctctgctccgactccgaccaccaccacctctgctgccagccccgtcctacatataaatccctccgtcatcatcgtcaaccgcagcgttgggccgctcaacaaacgcagccaccgccgccgccgccaccacgacaccaaccatataatcgcctgcccaagtcccaaccttttccgacccagccagacaccaccaccaccgtcgtcttcctcgccatggcccccgcggcgagcgcgaggttcccaccggtgtcatcctacgacgcgtccgcacgcacccgccgaaccgccgccgcggacctggacggcacgctgctcgcgtcctcctcggcgttcccctactacttcctcgtggcgctcgaggccggctcgtgcctccgcgcggcggcgctcctcctcgtggctccgctcctgctagcgctctacacgctggtgtccgaggcggcggccatcgcgctgctggcgttcgtcacgttcgcggggctgcgcgtgcgcgacgtcgaggccgtcgcccgcggcgtcctgccgcggcactacgcggccggcgtgcgcgccgacacctggaccgtgttccgcggctgcggcgaggggaggagggtcgtcgtcaccgcgtcccccgccgtcatggtgggcgagttcgtacgcgagttccttggtgctgaggtcgctggcaccgagctcgagaccttctccgcgttcggcgccgccaggtttacggggaggatcaaggccgtgctcgtcggggagaggaaggcggaggtcgtccggcggctcttcgccggtggggagatgcccgacgtcgggcttggggaccgcgagagtgaccatgacttcatggccatctgcaaggaagcttacatggtgcctccggacaagcgcgcggcgcgtgcggccgccgacacgctgctgtcccgctccgtcttccacgacggccgcctcgtccagcgcccggacccggcgcaggcgctgttcgcgctggcctacctcccgctgggcttcctgctggcgctgttccgcgtcttcttcaacctcatgatgccgctacgcctggtccgccacacgtaccgcctgacggggatccgcctccgcgtccggggcacgccgccgccgcccccggcgccgggcgccccgggttcgctgctggtctgcaaccaccgcacggcgctggacccgatcatcctgtccgtggcgctgggtcgccccgtgtcgtgcgtcacgtacagcgcgagccgcctctcgacggcgatctcgccgatccgggccgtcgcgctgtcccgggaccgcgccaccgacgcggcgcgcatggcggcgctgctggcggagggcgacgtcgtcgtgtgccccgaggggaccacgtgccgggagccctgcctgctccggttctcggcgctgttcgccgagctcacggaccggatcgtgcccgtggccatggaggcgcggcagggcacctactacgggtcgacggcgagggggtggaagtggctcgacccctacttcttctacatgaacccgcggccaggctacgacgtcacgttcctgccgccgctgcggccggaggagacgtgcggcgccggcgggaggagcgccgtcgacgtggctaaccacgtgcagagggtcatcgccaaggagctcgggttccagtgcaccacgctcaccaggaaggacaagtacatgaagctcgccggcaacgacggctcggtcgccgccagggctaaaaaggacgccgccgatgataacgctgccacggtcaccaccaccaagaagtttgtatgaagagatcgattatatatattggcaacctagctcgactatatcggagcagcattgtactgacgtaaaaaaaaaaaaaacatgcatgcacaaaaggtctagttaggcttatgtatattggagtatcgtgttcttttatttatactacgtatacgtagaaagaatggacgagtgaatggagtccaattttaaaggcgcaatttatatatgattatgattattttgggtagtgtatttgcttaaaaatctaaacacatactaaattgcattgcaacaatttaaatttttt

SEQ ID NO: 140 - DNA, 1547 bp, Ricinus communis
acacatatttcccactgctactagcttcccaaaactcacaccttaatctatcaaattggtcatgggggctcatcggcatttcgagtcaatcaagaaatgcagcaccgagggacggtcgaatcagacggtggctgcagacctggacggcacacttcttgtttcatcaagtgcttttccatacttcttgctcgttgcacttgaagctggaagcgtgttaagagctatactccttttagcatctgttcctttcgtgtattttacgtacctggttttatcagaggcaatagctatcaaaaccttcatctttattgcctttgcaggacttaaaataagggacgttgagcttgtttcgcggtctgtcttgcctagattctacgcggatgatgtccatcctgaaacttggagagtgttcaattcttttgggaaaagatatattgtcaccgccagtcctaggattatggttgaaccttttgttaagacctttttaggtgctgacaaagttcttggcactgaactagaggttacaaaatcgggaaaggcaactgggttcgtcaagaaacctggaattcttgttgctgaacataaaagagatgccattttaaaagaactgggcgctgatttgccagatttaggcctgtggagaccgagaaactgaccacaatttcatgtctatttgcaaggaaggatatatggtgccaagaacaaagtgtgagccactaccaagaaacaagcttctaagccctgtaatattccatgaaggacggttagttcaaaggccaacacctctagttgccctcttgacctttttatggatgccaatcggtataattctctcaatccttagggtataccttaatatccctttacctgaaagaattgcctattacaattacaaaattcttggaattaaagttatagttaagggcacccctcctcctgctccaagaaaaggccaaagtggagtcctttttgtatgcaaccatcgtactgttttagacccagtagtgacagcagttgccttaggcagaaagatcagttgtgttacatatagcataagcaaattcacagaaatcatatcgccaatcaaagcagtcgcattatcaagagaaagagagaaagatgctgctaatattaagcgtttattagaagaaggtgacttggtcatttgccctgaaggaacaacttgtagagagccatttcttttgagatttagtgccctttttgctgaacttaccgacagaattgtgcctgttgctatcaataccaagcaaacagttttccacggcacgactgtccgagggcataaattattggacccttattttgtgttcatgaatccaatgccaacctatgagatcacattcttgaatcagttgcctatagagcttacttgcaaaggtggtaaatcgtcgatcgaagttgccaattacattcagagggttcttgctggtacattggggtttgaatgtactaatttgacaaggaaggacaagtatgctatccttgctggtacagacggtcgtgttccatctaagaaggaaaagtaa

SEQ ID NO: 141 - DNA, 1549 bp, Arabidopsis lyrata
aagattcgccgcaagaaaacatgtctccggcgaagaagagccgaagttttcctccgataagcgagtgtaaaagcagagagtatgattcgatcgctgcggatctcgacggcactctgcttctctcaagaagctctttcccttacttcatgctcgtcgccattgaagcaggtagtctcttccgtggattgatccttcttctttctcttcccatcgtcatcatcgcttatctcttcgtctccgaatctctcggaatccaaatccttatctacatctccttcgccggtatcaaaatcaagaacatcgaactcgtctctcgcgccgttcttccacggttttacgcggcggatgtgaggaaagatagttttgaggtgtttgataaatgcaagaggaaagtggtggttactgcgaatccgatagtgatggttgagccattcgtcaaagattatttgggaggagaaaaagttttgggaacagagattgaagttaaccccaaaacgatgaaagctactggttttgttaaaaagcctggtgttcttgttggtgatttgaagagattagccatcttgaaagagttcggcgaagaatcaccggatattggactcggtgaccggacctccgatcacgatttcatgtccatttgcaaggaaggttacatggtgcatgagaccaaatcagccacaacagtccctatagagcgtctcaagaaccgcataatcttccacgatggccgtcttgtccaacgtccgacgccgttgaacgccttaatcatttacctttggcttcctttcggctttatgctctctatcttccgcgtctacttcaacctccctttacccgaacgcttcgttcgctacacttacgagatcctcggcattcacctcacaatccgtggccaccgtcctccccctccttcccccggcaaacctggaaacctttacgtccttaaccaccgaaccgcccttgaccccataattatcgccattgctctcggccgtaagatcacatgtgtcacttatagtgtctctcgcctctccctgatgctctcacccattcctgctgttgctctgacccgagaccgtgtcgctgatgcagcccgcatgagacaactcctcgagaaaggtgatttggtgatctgtcctgaaggcacaacgtgtagagaaccatatctactaagattcagtgctctatttgcggagctgagcgaccggatcgtgcctgtggccatgaactgcaagcaagggatgttcaacgggacgacagttagaggtgtgaaattctgggatccgtacttcttcttcatgaaccctcgacctagctacgaggccactttcttggaccgtttgcccgaagaaatgacggtaaacggtggtggcaagactccttttgaggtggctaattacgttcagaaggtgatcggtggagttttggggttcgaatgcactgaacttacaaggaaggataagtatctgttgcttggaggcaacgacggaaaggttgagtctatcaataagaccaagtccatggactaataatctagctagttactggt

SEQ ID NO: 142 - DNA, 1995 bp, Arabidopsis thaliana
ccaacacatttacttttcttcttcttctctctctacgccatagctatggttttaccagagcttctcgtgattctagcagaatgggttctttaccgtcttcttgctaaatcatgttacagagctgctagaaagctcagaggctatggtttccagttaaaaaatctcctaagcctctccaaaacacaatctctacacaacaattctcagcatcatcttcataaccatcatcaacaaaatcaccctaaccaaacccttcaagattctctagaccctctgttcccaagccttacaaaataccaagaacttcttctagacaaaaacagagcatgctctgtttcgtctgatcattatcgtgatacctttttctgcgatatcgatggtgttttattaagacaacattcgagcaaacacttccacacgttcttcccttacttcatgctcgtggcttttgaaggaggatcgatcatcagagcgatccttctcttgctctcctgttctttcctttggactctgcaacaagaaaccaaactcagagttctctctttcataaccttctctggtcttagagtcaaagacatggacaatgtttctagatcggttctaccaaaattcttcctcgagaacttgaatatccaagtttacgacatctgggctcgaactgagtactccaaagttgtgttcacgagcttgccgcaagtgctggtggagaggttcctcagagaacatctcaacgctgatgatgtgattgggactaaactgcaagaaataaaagtcatgggaaggaaattctacacaggcctagcttctggttctggtttcgtcctgaaacataaatcagctgaagactacttttttgatagcaagaagaagcctgcacttggaattggaagctcttcaagcccacaagatcacatcttcatctccatttgcaaagaagcttatttttggaatgaagaagagtccatgagcaagaacaacgcattgcctagagaaagatacccaaagccactgatattccacgacgggagattggctttcttgccaacaccattagctacattagccatgttcatatggctccctatcggatttttactcgctgtcttcaggatctcggtaggagtctttcttccttaccatgtagccaatttcttggcttctatgtccggtgttaggatcactttcaagacccataatttgaataacggtcgtccagagaaaggtaatagtggagtcttgtatgtatgcaaccataggaccctcctcgacccagttttcctcaccacttcgctgggcaagcccttgaccgcggttacttacagcctaagcaagttctccgagttcatagcacctctcaagacggttagccttaaaagagataggaagaaagacggtgaggcaatgcagagactattaagcaaaggagatctagtggtttgtccggagggaaccacatgtagagagccttatctactaaggttcagtcctttgttcgctgagttaactgaagacattgttcccgtggctgtagatgctcgagtgagcatgttctatgggacaactgcgagcgggctcaagtgtttagaccctatcttcttcctcatgaaccctaggccggtttattgtcttgagattttaaagaagttgccaaaagagatgacttgtgcaggaggcaagtcaagctttgaagttgcgaatttcatacagggagaacttgctagggttttgggatttgaatgcactaatctcacaaggagggataagtacttggttcttgctggaaatgaaggcattgtcagataaactattccgaattttcattagtttttttgtttgtttgaaaagctaaatattattgttatttcaggacttagatgtttaattctatatggttgattcattggcatcatttctatttcttatcactcgggaccattgatatgtattgaaaatgtttgctttatatgattttgtttctggatttgtatagtccat

SEQ ID NO: 143 - DNA, 1828 bp, Arabidopsis thaliana
gtctgaaaccaaacaaagaaaatacacgaaggaaggaaaagaaaagtaaaaagaaaagctttctgcaaaatccaaacatgtccgccaagatttcaatattccaagctcttgtctttctattctaccggtttatcctccggcgatatcggaactctaaaccaaaataccaaaatggcccttcttctctcctccaatccgacctatcacgccacacattgatcttcaacgtagaaggagctcttctcaaatccgactctctcttcccttacttcatgttagtagcatttgaggcgggaggcgtaataaggtcatttctcctcttcattctctatccattgataagcttgatgagccatgagatgggtgtcaaagtgatggtaatggtgagcttcttcgggatcaaaaaagaaggttttcgagcggggagagcggttttgcctaaatactttctagaagatgtcggactcgagatgttcgaagtgttgaagagaggagggaagaaaatcggagtgagtgatgatcttcctcaagttatgatcgaagggttcttgagagattacttggagattgacgttgtggtcgggagagaaatgaaagtcgttggaggttattatctaggtatcatggaggataaaaccaaacatgatcttgtctttgatgagttagttcgtaaagagagactaaacaccggtcgtgttattggcatcacttccttcaatacatctcttcaccgatatctattctctcagttttgccaggaaatttatttcgtgaagaaatcagacaagcgaagctggcaaaccctaccacgaagccagtaccctaaaccattgattttccatgatggccgtctcgcgatcaaaccaaccctaatgaacactttggtcttgttcatgtggggtcctttcgcagccgcagccgcagcagccagactcttcgtctctctttgcatcccttactctttatcaatcccgatcctcgccttttccggttgcagactaaccgtcactaacgactacgtttcatctcaaaaacaaaaaccaagtcaacgcaaaggttgtctctttgtttgtaaccataggactttattggaccctctctatgttgcattcgctttgagaaagaaaaacatcaaaactgtaacgtatagtttgagtagggtatctgagattttggctccgatcaagacggtgagactgacccgtgatcgggtgagcgacggtcaagccatggagaaattgttaaccgaaggagatctcgttgtttgtcctgaaggaaccacttgtagagaaccttacctgcttaggtttagccctttgttcaccgaggttagtgatgtcatcgttcccgtggctgtgacggtacacgtgaccttcttctacggtacaacggcgagtggtcttaaggcacttgacccgcttttcttcctcttggatccttatcctacctacaccatccaatttctcgaccctgtctccggtgccacgtgccaagatcctgatggaaagttgaagtttgaggtggccaacaatgttcagagtgatattgggaaggcgttggatttcgagtgcacaagtctcactagaaaagacaagtatttgatcttggccggtaataatggagtagttaagaaaaattaaaatttgttttaggatgatgagtgagtgatgagttcggttctttgggtatgtaagtaaccaatcgattatttcatttgtttattaataatgtctacgtaaatgtaactacaatctttttttcttggtaatgtacacatatgttctatatcatatccaaaatctttgtcagacaattttgcctttcatgc

SEQ ID NO: 144 - protein, 503 aa, Arabidopsis thaliana
MSPAKKSRSFPPISECKSREYDSIAADLDGTLLLSRSSFPYFMLVAIEAGSLFRGLILLLSLPIVIIAYLFVSESLGIQILIFISFAGIKIKNIELVSRAVLTRFYAADVRKDSFEVFDKCKKRKVVVTANPIVMVEPFVKDYLGGDKVLGTEIEVNPKTMKATGFVKKPGVLVGDLKRLAILKEFGDDSPDLGLGDRTSDHDFMSICKEGYMVHETKSATTVPIESLKNRIIFHDGRLVQRPTPLNALIIYLWLPFGFMLSVFRVYFNLPLPERFVRYTYEILGIHLTIRGHRPPPPSPGKPGNLYVLNHRTALDPIIIAIALGRKITCVTYSVSRLSLMLSPIPAVALTRDRVADAARMRQLLEKGDLVICPEGTTCREPYLLRFSALFAELSDRIVPVAMNCKQGMFNGTTVRGVKFWDPYFFFMNPRPSYEATFLDRLPEEMTVNGGGKTPFEVANYVQKVIGGVLGFECTELTRKDKYLLLGGNDGKVESINKTKSME

SEQ ID NO: 145 - protein, 501 aa, Arabidopsis thaliana [sequence omitted]

SEQ ID NO: 146 - protein, 289 aa, Arabidopsis thaliana
MVHATKSATTIPKERLKNRIVFHDGRLAQRPTPLNAIITYLWLPFGFILSIIRVYFNLPLPERFVRYTYEMLGIHLTIRGHRPPPPSPGTLGNLYVLNHRTALDPIIVAIALGRKICCVTYSVSRLSLMLSPIPAVALTRDRATDAANMRKLLEKGDLVICPEGTTCREEYLLRFSALFAELSDRIVPVAMNCKQGMFNGTTVRGVKFWDPYFFFMNPRPSYEATFLDRLPEEMTVNGGGKTPIEVANYVQKVIGAVLGFECTELTRKDKYLLLGGNDGKVESINNTKK

SEQ ID NO: 147 - protein, 503 aa, Arabidopsis thaliana
MSPAKKSRSFPPISECKSREYDSIAADLDGTLLLSRSSFPYFMLVAIEAGSLFRGLILLLSLPIVIIAYLFVSESLGIQILIFISFAGIKIKNIELVSRAVLTRFYAADVRKDSFEVFDKCKKRKVVVTANPIVMVEPFVKDYLGGDKVLGTEIEVNPKTMKATGFVKKPGVLVGDLKRLAILKEFGDDSPDLGLGDRTSDHDFKSICKEGYMVHETKSATTVPIESLKNRIIFHDGRLVQRPTPLNALIIYLWLPFGFMLSVFRVYFNLPLPERFVRYTYEILGIHLTIRGHRPPPPSPGKPGNLYVLNHRTALDPIIIAIALGRKITCVTYSVSRLSLMLSPIPAVALTRDRVADAARMRQLLEKGDLVICPEGTTCREPYLLRFSALFAELSDRIVPVAMNCKQGMFNGTTVRGVKFWDPYFFFMNPRPSYEATFLDRLPEEMTVNGGGKTPFEVANYVQKVIGGVLGFECTELTRKDKYLLLGGNDGKVESINKTKSME

SEQ ID NO: 148 - protein, 467 aa, Oryza sativa
MAFETGGVLRLLALILLAPLAGVLYYLVSESAGIQVLIFASMAGARVADVEAVARAVLPKFYCSDIHPESWRVFSACGRRCVLTANPRMMVEAFLKEYLGADIVVGTELVVWRGRATGLVRSPGVLVGENKAAALREAFGDASPEIGIGDRRTDYPFMRLCKEGYVVPVSPTPRPVPREELPKPVVFHDGRLVQKPSPALALLTVLWIPIGFVLACLRIAAGALLPMRVVYHAFRALGVRVTVKGTPPPPASRETGQSGVLFICSHRTLLDPIFLSTALGRPITAVTYSVSRLSEILSPIRTVRLTRDRAADAAMIRRLLAEGDLVICPEGTTCREPFLLRFSALFAELTDEIVPVAMENQMSMFHGTTARGWKALDPFYFFMNPSPGYVVTFLSKLPGELTCNGGGGGGGGRSSHEVANYIQRLIASTLSYECTSFTRKDKYRALAGNDGTVVSKPNIDEKKAMGC

SEQ ID NO: 149 - protein, 512 aa, Picea sitchensis
MAKGQSGLDCQGLFDVISKCSSKGRENQTVAADLDGTMLRSRSSFPYFMLVAMEGGSLLRGMVLLACAPMAWFLYNFISEAAGIQLLIFISFAGLKIRDIELVSRAVLPKFYAEDVHPESWRVFSAFGKRYIVTANPRIMVEPFVKGYLGADKVLGTELQVSRSGRATGFVKKPGVLVGDLKKAAVEAEFGDKLPELGLGDRETDHPFMSLCKEGYMVPKMKVDEVPTNKLMSPIVFHDGRLVQRPNPGAALLTFLWLPIGFFLAQFRVFGNIPIPEKYVKISYKIMGIKLVVKGTPPPAPKKKGERGVLFVCDHRTLLDPVIVAVALGRKVSAVTYSISRFSEIISPIKTVRLTRDRERDAANIKRLLEEGDLVICPEGTTCREPFLLRFSALFAELTDRIVPVAICNKMSMFHGTTVRGWKGFDPFFFFMNPVPTYEVTFLDQLPTELTCAGGKSPIEVANYIQRVLAATLGYECTNFTRKDKYRMLAGNDGIVSLNKTATARSNNHKQN

SEQ ID NO: 150 - protein, 502 aa, Zea mays
MVASPRFKPIEECCSEGRSEQTVAADLDGTLLISRSAFPYYLLVALEAGSVLRAALLLLSVPFVYVTYAFFSESLAISTLVYISVAGLKVRSIEMVARSVLPRFYAGDVHPESWRVFSSFGRRYVVTASPRVMVEPFARAFLGADKVVGTELEVGRDGKATGFMARPGVLVGDHKKKAVVKELGDALPDVGMGDRETDFDFMSICKEAYLVTSRKYSPVPRNQLLSPLIVHDGRLVQRPTPLVALVTFLWMPFGFALALMRVYINLPLPERIVYYTYKLMGIRLVVKGTPPPPPKKGHPGVLFVCNHRTVLDPVEVAVALRRKVSCVTYSISKFSELISPIKAVALSRERDKDAENIRRLLEEGDLVICPEGTTCREPFLLRFSALFAELTDRIVPVAINTKETMFHGSTVRGFKLMDPYFFFMNPRPTYEITFLTQLPKDLTCSGGKSPIEVANYIQKTLSGQLGFECTSITRKEKYGMLAGTDGRVPSKNKEKEKEKDKN

SEQ ID NO: 151 - protein, 500 aa, Arabidopsis thaliana
MSPEKKSQNFPPITECRDGEYDSIAADLDGTLLLSRSSFPYFMLVAVEAGSLLRGLILLLSLPFVIISYLFVSESLGIQILIFISFAGLKIRDIELVSRAVLPRFYAADVRKDSFEVFDKCKRKVVVTANPIVMVEAFVKDYLGGDKVLGTEIEVNPKTNRATGFVKKPGVLVGDLKRLAILKEFGNESPDLGLGDRTSDHDFMSLCKKGYMVHATKSATTIPKERLKNRIVFHDGRLAQRPTPLNAIITYLWLPFGFILSIIRVYFNLPLPERFVRYTYEMLGIHLTIRGHRPPPPSPGTLGNLYVLNHRTALDPIIVAIALGRKICCVTYSVSRLSLMLSPIPAVALTRDRATDAANMRKLLEKGDLVICPEGTTCREEYLLRSSALFAELSDRIVPVAMNCKQGMFNGTTVRGVKFWDPYFFFMNPRPSYEATFLDRLPEEMTVNGGGKTPIEVANYVQKVIGAVLGFECTELTRKDKYLLLGGNDGKVESINNTKK

SEQ ID NO: 152 - protein, 486 aa, Oryza sativa
MSPFKPIEQCSTEGRSQQTVASDLDGTLLLSRSAFPYYLLVALEAGGPLRAVALLMSVPFVYLTYVTISESLAVRALLYIAVAGLEVRDVESVARSVLPRFYAGDVHPEGWRVFSSFGRRCVVTASPRVMVEPFARAFLGADRVIGTELEVGEDGRATGFVAKPGVLIREHKRNAVVREFGDALPDVGMGDRESDFDFMAICKDAYVVTTSRKHRPVPESQLLRTVVLHDGRLAQRPTAINTLLVFLWMPVGFALALLRACLSLLLPERVLSYAYKLTGVGLVVRGRPPPPDGSPGVLFVCNHRTVLDQVAVAAALGRKVICVTYSVPRKTYGMSSRLPEALTASPVKAAVALCRERDRDADRVRRLLEEGVDIVAFPEGTTCRGAFLLRFSSLFAELTDRIVPVAIATRETMFHGSTARGFKGMDPYFFFMNPRPAYEVTFLSQLPSELTSGGGGKSPVEVANYVQKALAGQLGSEHIGITRKEK

SEQ ID NO: 153 - protein, 506 aa, Oryza sativa
MAAAAAAGRRRFFPPVTAYDAAAGARRTVAADLDGTLLVSSSAFPYYFLVALEAGSYLRALALLLAAPWLLALYVGVSEAAAIALLVFITFAGLRVRDVEAVARAVLPRHYAAGVRADTWAVFHGCAERRVVVTASPAVMVGEFVREFLGAEVAGTELETFASGKRFTGRIKAVLVGEKKREVVERLFAGGDMPDVGLGDRESDHDFMAICKEAYMVPKNKRAPRAAADELLSRAIFHDGRLVRRPEPASALFALAYLPVGFAVALLRVFLNLPVPARLVRHTYRLTGIRLAVRGAPPPPPRPGTPGSLLVCNHRTALDPIIVSIALGRPVTCVTYSVSRLSTAISPIRAAALTPDRAADAARIAALLEEGDVVVCPEGTTCREPYLLRFSALFAELTARIVPVAVEARQGTYYGSTARGWKFLDPYFFYMNPRPGYEVTFLPALRPEETCVAGGRSAVEVANHVQRVIAKELGFQCTTLTRKDKYMKLAGNDGRVAAAADKPKAN

SEQ ID NO: 154 - protein, 486 aa, Oryza sativa
MSPFKPIKQCSTEGRSQQTVASDLDGTLLLSRSAFPYYLLVALEAGGPLRAVALLMSVPFVYLTYVTISESLAVRALLYIAVAGLEVRDVESVARSVLPRFYAGDVHPEGWRVFSSFGRRCVVTASPRVMVEPFARAFLGADRVIGTELEVGEDGRATGFVAKPGVLIREHKRNAVVREFGDALPDVGMGDRESDFDFMAICKDAYVVTTSRKHRPVPESQLLRTVVLHDGRLAQRPTAINTLLVFLWMPVGFALALLRACLSLLLPERVLSYAYKLTGVGLVVRGRPPPPDGSPGVLFVCNHRTVLDPVAVAAALGRKVICVTYSVPRKTYGMSSRLPEALTASPVKAAVALCRERDRDADRVRRLLEEGVDIVAFPEGTTCRGAFLLRFSSLFAELTDRIVPVAIATRETMFHGSTARGFKGMDPYFFFMNPRPAYEVTFLSQLPSELTSGGGGKSPVEVANYVQKALAGQLGSEHIGITRKEK

SEQ ID NO: 155 - protein, 507 aa, Oryza sativa
MAAAAAAGRRRFFPPVTAYDAAAGARRTVAADLDGTLLVSSSAFPYYFLVALEAGSYLRALALLLAAPWLLALYVGVSEAAAIALLVFITFAGLRVRDVEAVARAVLPRHYAAGVRAETWAVFHGWAKRRVLVTALPAVMVGEFVREFLGAEVAGTELETFASGKRFTGRIKAVLVGEKKREVVERLFAGGDMPDVGLGDRESDHDFMAICKEAYMVPKNKRAPRAAADELLSRAIFHDGRLVRRPEPASALFALAYLPVGFAVALLRVFLNLPVPARLVRHTYRLTGIRLAVRGARRRPLRPGDAGAPSCCATTEPPRTPSSCPSALAAPLRALRTALAPLSTAISPIRAAALTRDRAADAARIAALLEEGDVVVCPEGTTCREPYLLRFSALFAELTARIVPVAVEARQGTYYGSTARGWKFLDPYFFYMNPRPGYEVTFLPALRPEETCVAGGRSAVEVANHVQRVIAKELGFQCTTLTRKDKYMKLAGNDGRVAAAADKPKAN

SEQ ID NO: 156 - protein, 497 aa, Oryza sativa
MVSRRFKPVEECSSDGRSEQTVAADFDGTLVRSRSAFPYYLLVALEAGSVLRAVVLLLSVPFVYVTYIFFSESLAISTLVYISVAGLKVRNIEMVARSVLPKFYAEDVHPESWRVFNSFGKRYIITASPRIMVEHFAKTFLGADKVVGTELEVGKNGKATGFMVKPGVLVGDHKRQAVVKELRDAVPDVGLGDRETDFDFMSICKEAYLVTSRKYSAVPKNQLLSPLILHDGRLVQRPTPLVALVTFLWMPFGFVLALLRVYVNLPLPERIVFYTYKLMGIRLIVKGNPPPPPKKGHPGVLFVCNHRTVLDPVEVAVALRRKVSCVTYSISKFSELISPIKAVALSREREKDAENIRRLLEEGDLVICPEGTTCREPFLLRFSALFAELTDRIVPVAINTKESMFHGSTVRGFKLMDPYFFFMNPRPTYEITFLNQLPKELTCSGGKSPIEVANYIQKTLSGQLGFECTAITRKEKYSILAGTDGRVPSKNKEKEKN

SEQ ID NO: 157 - protein, 505 aa, Oryza sativa
MIASPFPAVEKCSSKDRGGDTIVADLDGTLLCGRSSFPYFAHMAFETGGVLRLLALILLAPLAGVLYYLVSESAGIQVLIFASMAGARVADVEAVARAVLPKFYCSDIHPESWRVFSACGRRCVLTANPRMMVEAFLKEYLGADIVVGTELVVWRGRATGLVRSPGVLVGENKAAALREAFGDASPEIGIGDRRTDYPFMRLCKEGYVVPVSPTPRPVPREELPKPVVFHDGRLVQKPSPALALLTVLWIPIGFVLACLRIAAGALLPMRVVYHAFRALGVRVTVKGTPPPPASRETGQSGVLFICSHRTLLDPIFLSTALGRPITAVTYSVSRLSEILSPIRTVRLTRDRAADAAMIRRLLAEGDLVICPEGTTCREPFLLRFSALFAELTDEIVPVAMENQMSMFHGTTARGWKALDPFYFFMNPSPGYVVTFLSKLPGELTCNGGGGRSSHEVANYIQRLIASTLSYECTSFTRKDKYRALAGNDGTVVSKPNIDEKKAMGC

SEQ ID NO: 158 - protein, 474 aa, Oryza sativa
MGDPPMIASPFPAVEKFSSKDRGGDTIVPDLDGTLLCGRSSFPYFGHMAFKTGGVLRLLALILLAPFAGLLYYLVSDSAGIQVLIFASMAGPRVPDFKAAFLKEYLGADIVVGTELVVWRGRATGLVRSPGVLVGENKAAALREAFGDASPEIGIGDRRTDYPFMRLCKEGYVVPVSPTPRPVPREELPKPVVFHDGRLVQKPSPALALLTVLWIPIGFVLACLRIAAGALLPMRVVYHAFRALGVRVTVKGTPPPPASRETGQSGVLFICSHRTLLDPIFLSTALGRPITAVTYSVSRLSEILSPIRTVRLTRDRAADAAMIRRLLAEGDLVICPEGTTCREPFLLRFSALFAELTDEIVPVAMENQMSMFHGTTARGWKALDPFYFFMNPSPGYVVTFLSKLPGELTCNGGGGGGGGRSSHEVANYIQRLIASTLSYECTSFTRKDKYRALAGNDGTVVSKPNIDEKKAMGC

SEQ ID NO: 159 - protein, 497 aa, Selaginella moellendorffii
MADLKYSRLVQFGLVENCSSEGRGMHTVAADLDGTLLRRRSSFPYFLLVALEGGSLFRAVVLGLLAPIAWLLYHFVSEAAAIQLLIYVSFSGQKVSEIEKVATAVLPKFYSQDVHSDAFRVFSSCGKKYVITANPRIMVEYFCKAFLGADKVIGTEIEVDDDGRATGFVKFPGVLVSQNKRTALKLEFVDGELPEIGLGDRETDFAFMSLCKEAYVVPKRKVDAVDGSALAQRVIFHDGRLVQLPTPFVALVTFLWLPIGFALAVLRIGLTSRCPRKYMGMIYAILGVRRITKGKVPRKQDGRGLLFVCNHRTLVDPIFLGLAAERDVTGLTYSISRVSEVLSPIVTVRLTRDKERDFTKMKSLLERGRDLCLCPEGTTCREPFLLRFSALFTQLTHRIVPAAVKTRQSMFNGTAVRGWKGMDPFFFFMNPFPTYEVEFLEELPAEMSVQKGGKSSFETANFIQKMLGDKLGYECTTFTRKDKYLMLNGSDGTVPTK

SEQ ID NO: 160 - protein, 534 aa, Selaginella moellendorffii
MSLDGGKVTDSFLVDAPFEPVERCSSAGREKQTCVADFDGTLIRGRSSFPYFMLVALEGGGLIRSVILGLFAPLAWILYHFVSESAGIRLLIFISFAGMKAKQIESVSRAVLPKFYSEDVHSEAYRVFSSCGKRVVVTANPRIMVEHFAKTCLGADKVLGTEIEVTRSGYATGFLKRPGVLVGVNKRKAVRQEFGEHLPHVGIGDRATDFAFMALCKEAYVVPPSKVEALSRDKLVKPVVFHDGRLVQRPTPLTALVTFLWLPVSFVLAVFRIMVTVPCPREYVTIVYKLVGIRLIVKGPIPPPKKRGESGVLFVSSHRTLCDPVFVGVGARREVTALTYSISRVSEFLSPIKTVGLSRDRERDAAKIKALLQKGDLCICPEGTTCREPFLLRFSALFAELTDKIVPVALCTKGSTFHGTTVRGWKGLDPFFFFMNPFPTYEVTFLQQLPPELTVQQGGKSAIEVANHIQRVIADTLGFECTNFTRKDKYGMLAGNDGTVPERRRSGGGGGGAAKDLPKDEQAAQGQDQVNGCS

SEQ ID NO: 161 - protein, 494 aa, Selaginella moellendorffii
MAEFPPIEKCGTTISRESESVASDLDGTLLRGRSSFPYFFLTTFETSGILRSWLLLLVSPLVWLLYHFISEAAGIKLLIFASLAGVPVSQIECIARSVLPRFYLQDLNPETWKVFSSFGKKIVVTANPRILVESLCKEFLGADEVIGTELEVDNRGRATGFVKSPGVLVGENKAKALLQACDPEQLPDVGLGDRQTDFPFMKLCKEGYVVPPSNNVEPVPKSQLLKPIIFHDGRLVQLPTPLVALVTLLWIPVGFVLACLRIAAGSLLPMSIVYHAFWLLGVRVTVKGTPPPRATKNSRGVLFICSHRTLLDPIFLSCALGRGVSAVTYSVSRLSEILSPIKTVALSRNRYKDAAQIRELLKEGDLVICPEGTTCREPFLLRFSALFAELADDIVPVAMDNRMSMFHGTAARAWKGMDPFYFFMNPSPSYEVTFLQQLPEELTCKGGKSSHEVANHIQRALAGVLDFECTNLTRKDKYKALVGTDGSVETKKST

SEQ ID NO: 162 - protein, 494 aa, Selaginella moellendorffii
MAEFPPIEKCSSTISRESESVASDLDGTLLRGRSSFPYFFLTTFETSGILRSWLLLLVSPLVWLLYHFISEAAGIKLLIFASLAGVPVSQIECIARSVLPRFYLQDLNPETWKVFSSFGKKIVVTANPRILVESLCKEFLGADEVIGTELEMDSRGRATGFVKSPGVLVGENKAKALLQACDPEQLPDVGLGDRQTDFPFMKLCKEGYVVPPSNNVEPVPKSQLLKPIIFHDGRLVQLPTPLVALVTLLWIPVGFVLACLRIAAGSLLPMSIVYHAFWLLGVRVTVKGTPPPRATKNSRGVLFICSHRTLLDPIFLSCALGRGVSAVTYSVSRLSEILSPIKTVALSRNRDKDAAQIRELLKEGDLVICPEGTTCREPFLLRFSALFAELADDIVPVAMDNRMSMFHGTAARAWKGMDPFYFFMNPSPSYEVTFLQQLPEELTCKGGKSSHEVANHIQRALAGVLDFECTNLTRKDKYKALVGTDGSVESKKST

SEQ ID NO: 163 - protein, 490 aa, Selaginella moellendorffii
MEHPYDVIDNCSADNREKQSVVADLDGSCVRSRSSFPYFMLVALEGGSLLRSVLLMVMAPVAWLLYHFVSEAAGIKVLIFFSCAGQRARDIEAVARAVLPKFYSEDVHSSTWRVFSSCGKRYILTASPRLMVEHFATTYLGADKVIGTELQVTRSGYATGFVKSPGVLVGVNKRRALKAVFGEEVPDLGIGDRSSDYPFMAFCKEAYIVPSQPADAVPAHKLARKIIFHDGRLVQRPTPFVALVTFLWLPAGFLLAFFRILVALPCPVEYVPLLYKVIGVRLIVKGKVPPPSKNGILFVCTHRTLIDPIMASAASGSDVTALTYSISRVSEVLSPIKTVPLSRDRERDASNIKRLLLKENLAICPEGTTCREPFLLRFSALFAELSENIVPVATSTKTSIFHGTTVRGWKGMDPFFFFMNPFPVYEVTFLERLPHDLSVQGGKSAIEVANYIQRVLADTLGFECTNFTRKDKYGMLIGSDGTVPARKKSF

SEQ ID NO: 164 - protein, 497 aa, Selaginella moellendorffii
MADLKYSRLFRFGLVENCSSEGRGMHTVAADLDGTLLRGRSSFPYFLLVALEGGSLFRAVVLGLLAPIAWLLYHFVSEAAAIQLLIYVSFSGQKVSEIEKVATAVLPKFYSQDVHSDAFRVFSSCGKKYVITANPRIMVEYFCKAFLGADKVIGTEIEVDDDGRATGFVKFPGVLVSQNKRTALKLEFVDGELPEIGLGDRETDFAFMSLCKEAYVVPKRKVDAVDGSALAQRVIFHDGRLVQLPTPFVALVTFLWLPIGFALAVLRIGLTSRCPRKYMGMIYAILGVRRITKGKVPRKQDGRGLLFVCNHRTLVDPIFVGLAAERDVTGLTYSISRVSEVLSPIVTVRLTRDKQRDFTKMKSLLERGRDLCLCPEGTTCREPFLLRFSALFTELTHRIVPAAVKTRQSMFNGTAVRGWKGMDPFFFFMNPFPTYEVEFLEELPVEMSVQKGGKSSFETANFIQKMLGDKLGYECTTFTRKDKYLMLNGSDGTVPTK

SEQ ID NO: 165 - protein, 534 aa, Selaginella moellendorffii
MSLDGGKVTDSFLVDAPFEPVERCSSAGREKQTCVADFDGTLIRGRSSFPYFMLVALEGGGLIRSVILGLFAPLAWILYHFVSESAGIRLLIFISFAGMKAKQIESVSRAVLPKFYSEDVHSEAYRVFSSCGKRVVVTANPRIMVEHFAKTCLGADKVLGTEIEVTRSGYATGFLKRPGVLVGVNKRKAVRQEFGEHLPHVGIGDRATDFAFMALCKEAYVVPPSKVEALSRDKLVKPVVFHDGRLVQRPTPLTALVTFLWLPVSFVLAVFRIMVTVPCPREYVTIVYKLVGIRLIVKGPIPPPKKRGESGVLFVSSHRTLCDPVFVGVGARREVTALTYSISRVSEFLSPIKTVGLSRDRERDAAKIKALLQKGDLCICPEGTTCREPFLLRFSALFAELTDKIVPVALCTKGSTFHGTTVRGWKGLDPFFFFMNPFPTYEVTFLQQLPPELTVQQGGKSAIEVANHIQRVIADTLGFECTNFTRKDKYGMLAGNDGTVPERRRSGGGGGGAAKDLPEDEQAAQGQDQVNGCS

SEQ ID NO: 166 - protein, 497 aa, Oryza sativa
MVSRRFKPVEECSSDGRSEQTVAADFDGTLVRSRSAFPYYLLVALEAGSVLRAVVLLLSVPFVYVTYIFFSESLAISTLVYISVAGLKVRNIEMVARSVLPKFYAEDVHPESWRVFNSFGKRYIITASPRIMVEHFAKTFLGADKVVGTELEVGKNGKATGFMVKPGVLVGDHKRQAVVKELRDAVPDVGLGDRETDFDFMSICKEAYLVTSRKYSAVPKNQLLSPLILHDGRLVQRPTPLVALVTFLWMPFGFALALLRVYVNLPLPERIVFYTYKLMGIRLIVKGNPPPPPKKGHPGVLFVCNHRTVLDPVEVAVALRRKVSCVTYSISKFSELISPIKAVALSREREKDAENIRRLLEEGDLVICPEGTTCREPFLLRFSALFAELTDRIVPVAINTKESMFHGSTVRGFKLMDPYFFFMNPRPTYEITFLNQLPKELTCSGGKSPIEVANYIQKTLSGQLGFECTAITRKEKYSILAGTDGRVPSKNKEKEKN

SEQ ID NO: 167 - protein, 506 aa, Oryza sativa
MAAAAAAGRRRFFPPVTAYDAAAGARRTVAADLDGTLLVSSSAFPYYFLVALEAGSYLRALALLLAAPWLLALYVGVSEAAAIALLVFITFAGLRVRDVEAVARAVLPRHYAAGVRADTWAVFHGCAERRVVVTASPAVMVGEFVREFLGAEVAGTELETFASGKRFTGRIKAVLVGEKKREVVERLFAGGDMPDVGLGDRESDHDFMAICKEAYMVPKNKRAPRAAADELLSRAIFHDGRLVRRPEPASALFALAYLPVGFAVALLRVFLNLPVPARLVRHTYRLTGIRLAVRGAPPPPPRPGTPGSLLVCNHRTALDPIIVSIALGRPVTCVTYSVSRLSTAISPIRAAALTRDRAADAARIAALLEEGDVVVCPEGTTCREPYLLRFSALFAELTARIVPVAVEARQGTYYGSTARGWKFLDPYFFYMNPRPGYEVTFLPALRPEETCVAGGRSAVEVANHVQRVIAKELGFQCTTLTRKDKYMKLAGNDGRVAAAADKPKAN

SEQ ID NO: 168 - protein, 515 aa, Zea mays
MAARFPPVSSYDASARVRRTAAADLDGTLLASSSAFPYYFLVALEAGSCARALLLLLAAPLLLALYTLVSEAAAIALLAFVTFAGLRVRDVEAVARGVLPRHYAAGVRADTWAVFRDCGAARRVVVTASPAVMVADFVREFLGAELAATELETCRALGDAWFTGRIKAVLVGERKAEVVRRLFAAGDLPDVGLGDRESDHDFMAICKEAYMVPPDRRAPRAAADALLSRAVFHDGRLVRRPDPAHALFALAYLPLGFLLALFRVLFNLAMPARLVRHTYRLTGIRLRVRGTPPPAPAPGAPGSLLVCNHRTALDPIIVSVALGRPVACVTYSVSRLSTAVSPVRAVALSRDRAADAARIAALLAEGDVVVCPEGTTCREPCLLRFSALFAELTDRIVPVALDARQGTYYGSTARGWKWLDPYFFYMNPRPGYDVTFLPPLRPEETCGAGGRSAVDVANHVQTLIAKELGFRCTKLTRKDKYMKLAGNDGTVGGRPENEKGAADDSAATATTKKLV

SEQ ID NO: 169 - protein, 500 aa, Zea mays
  misc_feature (92)..(92): Xaa can be any naturally occurring amino acid
MVASPRFKPIEECCSEGRSEQTVAADLDGTLLISRSAFPYYLLVALEAGSVLRAALLLLSVPFVYVTYAFFSESLAISTLVYISVAGLKVRXIEMVARSVLPRFYAGDVHPESWRVFSSFGRRYVVTASPRVMVEPFARAFLGADKVVGTELEVGRDGKATGFMARPGVLVGDHKKKAVVKELGDALPDVGMGDRETDFDFMSICKEAYLVTSRKYSPVPRNQLLSPLIVHDGRLVQRPTPLVALVTFLWMPFGFALALMRVYINLPLPERIVYYTYKLMGIRLVVKGTPPPPPKKGHPGVLFVCNHRTVLDPVEVAVALRRKVSCVTYSISKFSELISPIKAVALSRERDKDAENIRRLLEEGDLVICPEGTTCREPFLLRFSALFAELTDRIVPVAINTKETMFHGSTVRGFKLMDPYFFFMNPRPTYEITFLTQLPKDLTCSGGKSPIEVANYIQKTLSGQLGFECTSITRKEKYGMLAGTDGRVPSKNKEKEKDKN

SEQ ID NO: 170 - protein, 486 aa, Zea mays
MVSRRFKPIELCDSEGRSRQTVAADLDGTLLLSRSAFPYYLLIALEAGSLLRAVALLLSVPLVYLTYVTVSETLAVRAFIYVAMAGLEARDIEAVARSVLPSFYAGDVHPEGWRVFRSFGRRCVVTASPRLMVEPFAKAFLGADVVIGTEVEVAQSGKATGFVAGPGVLVGEHKRRAVAREFGDSLPDVGMGDRESDFDFMSICKEAYTVTRQKYRALPRDQLQGRAILHDGRLARRPTATNALLTFLWMPLGFALALVRAHLHLLLPVRALAYAYKLTGVKLVVRGNRPPPSKKKKGDQLGVLFVCNHRSTLDAVAVGVALGRKVRWVVTDGGAGASRFSEPVVSPIMTGVPLPVPTSLEGDADADAAPRIRRLLEEGDDVVVFPEGAICREPFLLRFGALFAEVTDRIVPVAIEPRESMFHGSTARGLRGMDPYFFFMNPRPTYEVTFLNQLPGELTCGGGRSPVEVASYVQEVLAAQLGFECT

SEQ ID NO: 171 - protein, 505 aa, Brassica napus
MSPAKKKSTSFPPISECKSGEYDSIAADLDGTLLLSRSSFPYFMLVAIEAGSLFRGLILLLSLPIVIIAYLFVSEALGIQILIYISFAGIKIRDIELVSRAVLPRFYAADVRKDSFEVFDKCKRKVVVTANPIVMVEPFVKDYLGGDKVLGTEIEVNPKTMKATGFVKKPGVLVGDLKRLAILKEFGDESPDLGLGDRTSDHDFMSICKEGYMVHETKSATTVPIERLKNRIIFHDGRLVQRPTPLNALIIYLWLPFGFMLSIFRVYFNLPLPERFVRYTYEILGIHLTIRGHRPPPPSPGTPGNLYVLNHRTALDPIIIAIALGRKISCVTYSVSRLSRMLSPIPAVALTRDRAADAARMRKLLEKGDLVICPEGTTCREPYLLRFSALFAELSDRIVPVAMNCKQGMFNGTTVRGVKFWDPYFFFMNPRPSYEATFLDRLPEEMTVNGGGKTPIEVANYVQKVIGGVLGFECTELTRKDKYLLLGGNDGKVESIKKTKDDKSS

SEQ ID NO: 172 - protein, 500 aa, Arabidopsis thaliana
MSPEKKSQNFPPITECRDGEYDSIAADLDGTLLLSRSSFPYFMLVAVEAGSLLRGLILLLSLPFVIISYLFVSESLGIQILIFISFAGLKIRDIELVSRAVLPRFYAADVRKDSFEVFDKCKRKVVVTANPIVMVEAFVKDYLGGDKVLGTEIEVNPKTNRATGFVKKPGVLVGDLKRLAILKEFGNESPDLGLGDRTSDHDFMSLCKKGYMVHATKSATTIPKERLKNRIVFHDGRLAQRPTPLNAIITYLWLPFGFILSIIRVYFNLPLPERFVRYTYEMLGIHLTIRGHRPPPPSPGTLGNLYVLNHRTALDPIIVAIALGRKICCVTYSVSRLSLMLSPIPAVALTRDRATDAANMRKLLEKGDLVICPEGTTCREEYLLRFSALFAELSDRIVPVAMNCKQGMFNGTTVRGVKFWDPYFFFMNPRPSYEATFLDRLPEEMTVNGGGKTPIEVANYVQKVIGAVLGFECTELTRKDKYLLLGGNDGKVESINNTKK

SEQ ID NO: 173 - protein, 514 aa, Physcomitrella patens
MQQLDPLTSFHCSESFEGVETCRVEGRANQSIVSDLDGTLLRSRSSFPYFMLLAFEAGSPLRSVVLLLISPVVWLVYNFVSEAAGIKMLIFVSLAGLKVSAVESVARGVLPKFYLEDMHSISYRVFTSCGKRYVVTANPRIIVEPFLKEYLDVEAVMGTELQISSGGYVTGFVTGPGVLVGAVKERAVKKYFGPDPPDVGLGDRQSDFLFMDLCKESYIVHSDKDVPAVSKEDFLKPLIFHDGRLVCRPTPLMSLIVMLWCPIGFVLAVVRMLIGIALPMWWALPLEAMLGVTVRVKGIPPTCPLRNKKRGVLFVCSHRTLLDPIFLSIAVRRKVTAVTYSISRLSEVLSPIRTVRLTRDRNTDANTMASLLEEGDLVVCPEGTTCREPYLLRFSSLFAELTDQIVPVTMNIKITMFHGTSARGWKGMDPFFFFMNPCPKYEVTFLDQLPHQLTCNGGKTSHEVANYIQRVLANSLGFQCTNLTRKDKYTVLAGNDGIVPDHTLRQRAGRMFGL

SEQ ID NO: 174 - protein, 501 aa, Physcomitrella patens
MKRDPFDTIDKCSDKGRSKQTVVSDLDGTLLRSRSSFPYFMLVAFEAGGVARAFVLLLCSPLCWLLYHCVSESIGIRLLIFVTFAGLKIGGIEAIARGTLPKFYAEDVHPDTWRIFSSFGERYILTATPRIMAETFAKTYLGVDGVLGTELHFTSGGIATGLLMNPGVLTGRNKEIVLRQEFQGLNLPDVGLGDRPSDHNFMSICKEGYIVPPSNTILAASKESLMNLLVFHDGRLIQRPTAGIALIILLWYPIGAVLAVLRILAGILLPFHLLKLVYKFLGVGVVVRGTPPPEPKDGPGRGGYLYVCSHRTLLDPVMVGVALKRRVTAVTYSISRLSEVLSPIKTVALKRNREKDAAKIRSLLREGDLAICPEGTTCREPYLLRFSALFAELSNQLVPVAMNTRMSMFHGTTAQGWKCLDPFYFFMNPNPIYEVTFLNELPVELTCAGGKSSYEVANHIQQLLSQTLGFECTNYTRKDKYGVLCGNDGSIPLKSQDSFGS

SEQ ID NO: 175 - protein, 517 aa, Physcomitrella patens
METQEPDPVTSFHCSENYDEVENCRVEGRANQSIVSDLDGTLLRSRSSFPYFMLLAFEAGSPLRFIILLLVSPIVWFVYNFISEVVGIKMLIFISLAGLKVSAIESVARGVLPKFFLEDMHSISYRVFISCEKRYVVTANPRIIVEPFLKEYLDVDAVMGTELQISSGGYATGFVTGPGVLVGTAKQRAVKKYFGSDQPDLGLGDRTSDFAFMDLCKEAYIVPSYKEVPSVTKKDYLKPLIFHDGRLVCRPTPLMALAVTLWCPIGFVLAIIRMFIGIMLPMWWALPLEAMLGVTVRIKGIPPTCPLRSKKRGVLFVCSHRTLLDPIFLSIAVRRKVTAVTYSISRLSEVLAPIRTVRLTRDRNTDASTMASLLDEGDLVVCPEGTTCREPYLLRFSSLFAELTDQIVPVTMNIKISMFHGTSARGWKGMDPFFFFMNPRPKYEVTFLDQLPHQLTCNGGKTSHEVANYIQRVLANSLGFQCTNLTRKDKYRVLAGNDGIVPDRSLRQRASRIFGLQ

SEQ ID NO: 176 - protein, 504 aa, Physcomitrella patens
MEVTKLKEAGNYSFAEVKSCSSGNDRRSQTVVADLDGTLIRGRSAFPYFFLVAFEAGSYFRALLLSLMAPLIGFLYYFVDEASGIHLMIFLSFAGLKIKDIEGVARAVLTKFYADDLHPETWRVFSSFGKRVVLTANPRVMVEPFLKEVLGADEVMGTEIEVNKKGRATGRLLKPGVLVGTHKEEALKRCNIGGERPHVGLGDRVTDFPFMAYCKEGYVVPKTKVPAVKKQDMPKQLIFHDGRLVQLPTPRNAFKVLAWMPIGLLLSIVRVTMGVWVPIRLMPLCYKLTGINLVVKGNIPEKPKNGEPGRLFVCNHRTLLDPVIIALALGRPVPAVTYSISKVSEFLSPMPTIGLCRDREKDSANMRRVLKEGELTLCPEGTTCREPFLLRFSALFAELSDRIVPVAVKINMNMFHGTTARGNKAMDPFFAYMNPRPTIELKFLDEIPKNMTCGSGKSSIEVANYIQHLLAGELGYDCTDFTRKDKYRLLAGNDGIVPVKEKTR

SEQ ID NO: 177 - protein, 529 aa, Physcomitrella patens
MEIPGVFDANLFCAESFPEVETCKVEGREKQTIISDLDGTLLRSRSSFPYFMLIAFDAGSPLRFIVLLLASPIIWLVYNFFSEAAGTKLLIFIACAGLKASDIESVARGVLPKFYLEDMHSVSYSIFVSCGKRYVVTANPRIMVESFLKEYMGVEAVIGTELHITKSGYATGLVMGAGVIVGANKTRAVKKYFGDDLPDIALGDRASDFPFMALCKEAYLVPSFKPVEPVAKADYLKPLIFHDGRLVCRPTPLMSLVIILWSPIGLILALIRMVFGTVLPMWYALPLEAMLGVSIRVKGIPPSCPQTSGRRGVLFVCSHRTLLDPIFLSIACRRQVTAVTYSISKVSEILSPIPTVRLTRCRKTDAETMTKLLNEGDLAVCPEGTTCREPYLLRFSSLFAELADQIIPVTMNVKTTMFHGTTARGWKALDPFIFLMNPSPRYELEFLDQLPHEMTCSGGKSSHEVANYIQRVLAASLGFKCTNLTRRDKYRILAGNDGVVPASHFLKQRSRIFACLPSRNSERGQRSDP

SEQ ID NO: 178 - protein, 503 aa, Vitis vinifera
MAVTTFPTVDQCQSIGREKHTVVADMDGTLLIGRSSFPYFALVAFEGGGVLRLLFLLLASPLAGLLYYFVSESAGIQILIFVTFAGMKVSDIESVARAVLPKFYLSDLHPESWRVFSSCGKRCVLTANPRIMVEAFLKDFLGADLVLGTEIATYKGRATGFVCDPGVLVGKNKAYALNKTFGETQPEIGLGDRHTDFPFMASCKEGYIVAAKPEVKAVTSDKLPKPIIFHDSRLVQKPTPLTALLTLLWIPIGFALACLRIAAGSLLPMRIVYHAFWALGVRVSVKGSPPPVAKKSIGQSGVLFICSHRTLLDPIFLSAALGRPIPAVTYSVSRLSEFISPIKTIRLSRDRVKDAAMIKKLLEEGDLAICPEGTTCREPFLLRFSALFAELTDQLVPVAMMNRMSMFHGTTARGWKGMDPFFFFMNPSPAYEVTFLNKLPLELTCSSGKSSHEVANYMQRVIAATLSYECTSFTRKDKYRALAGNDGTVPKKPLLYPDKVMGC

SEQ ID NO: 179 - protein, 501 aa, Vitis vinifera
MSPPPKRARKFPSITTYAGGDHRSIAADLDGTLLVSRSSFPYFMLVAVEAGSLLRGLFLLLSLPIVIVAYLFISEEIGIQILIFISFSGLKIRDIELASQAVLPRFYANDVRRESWEVFEKCERKVVVTANPTLMVEPFVRDFLGGTKVLGTEIEVNPKTKKATGFVKKPGVLVGDRKRLALLKEFGDELPDIGIGDRESDHDFMSICKEGYMVLPSKSATPVPPNRLKTPIIFHDGRFVQPPTPLTALIIYLWLPFGFALSIFRVYFNLPLPERIVRYTYPMLGINLVIRGNPPPPPSPGSPGNLYVCNHRTALDPIVIAIALRRKVSCVTYSVSRLSRFLSPIPAVALTRDRAADAARISSILQKGDLVVCPEGTTCREPYLLRFSALFAELSDRIVPVAVNVKQNMFHGTTVRGVKFWDAYFYFMNPRPTYEITFLDRLPEEMTCKAGGKSAIEVANHVQKVLGGVLGFECTGLTRKDKYMLLGGNDGKVESMYNAKK

SEQ ID NO: 180 - protein, 510 aa, Vitis vinifera
MTKSNLHSPPTSLTIDQCTSIGREKETVVADMDGTLLRGRSSFPYFALVAFEVGGIFRLLLLLLCSPLAGVLYYFISEPAGIQVLIFATFVGMKVSDIESVARAVLPKFYASDLHPEAWRVFSSCGKRCVLTANPRIMVEAFLKDFLGADMVLGTEVDTYKGRATGLVRGGGVLVGKRKAEALRNAFSETSLPEIGLGDRETDYPFMSLCKESYIVPAKPEVEAVSHDKLPKPIVFHDGRLVQKPTPFMALLTILWIPVGFLLACLRIAAGALLPMPLVYYAFWALGVRVYIKGNPPPPAKKSIGQSGVLFICSHRTLLDPIFLSAALGRPIPAVTYSLSRLSEFISPIKTVRLSRDRATDAAMIKKLLEAGDLAICPEGTTCREPFLLRFSALFSELTDELVPVAMANRMTMFHGTTARGWKGMDPFYYFMNPSPAYEVNFLNKLPHELTCGAGKSSHDVANYIQRMIAASLSYECTNFTRKDKYRALAGNDGTVVEKPKVDANKVMGC

SEQ ID NO: 181 - protein, 499 aa, Vitis vinifera
MGAQRHFQPISKCSSDGRANQTVAADLDGTLLVSRSAFPYFMLVALEAGSLVRAILLLASVPLVYFIYLFISESLAIKIFIYMAFAGLKVREIELVSRSVLPKFYAEDVHPESWRVFNSFGKRYIITANPRIMVEPFVKTYMGADKVLGTELEVSNSGRATGFVKKPGVLVGEHKKAAVQQEFGMNLPDVGLGDRDTDHDFMSLCKEGYMVPRTKCEPLPRNKLLSPVIFHEGRLVQRPTPVAALLTFLWMPIGIILSILRVYLNIPLPERIVRYNYKILGIKLIVKGTPPPPPKGGQSGVLFVCNHRTVLDPVVTAVALGRKISCVTYSISKFSELISPIKAVALSREREKDAANIKRLLEEGDLVICPEGTTCREPFLLRFSALFAELTDRIVPVAINTKQSVFYGTSTRGYKLLDPYFVFMNPMPTYEITFLNQLPAELTCKGGKSPIEVANYIQRVLAGTLGFECTNLTRKDKYATLAGTDGSVPFKNEKEKEKA

SEQ ID NO: 182 - protein, 497 aa, Populus trichocarpa
MVMGAHRHFEPIAKCSTEGRSNQTVAADLDGTLLVSRSAFPYFLLVAIEAGSLLRGLILLASVPFVYFTYLFISEAMAIKTFIFIAFAGLKIRDIELVSRSVLPKFYADDVHPETWRVFNSFGKRYIVTANPRIMVEPFVKTFLGADKVLGTELEATKSGRATGFIKKPGVLVGDHKRDALLKEFGTNLPDLGLGDRETDHDFMSICKEGYMVPGTKCEPLARNKLLSPVIFHDGRLVQRPTPLAALLTFLWMPIGIILSILRVYLNIPLPERLAWYTYKLLGIRVIVKGTPPPPPGKGHSGVLFVCNHRTVLDPVVTAVALGRKISCVTYSISKFTEIISPIKAVALSRERDKDAANIKRLLEEGDLVICPEGTTCREPFLLRFSALFAELTDRIVPVAINTKQSVFHGTTVRGHKLLDPYFVFMNPMPTYEVTFLNQLPKELTCKGGKSAIEVANYIQRVLAGTLGFECTNLTRKDKYAKLAGTDGRVLSKKENA

SEQ ID NO: 183 - protein, 501 aa, Populus trichocarpa
MVSFPTVDKCASIGREKHSVVADMDGTLLRGRSSFPYFALLAFEAGGIFRLLFLLLNSPLAGLLYYFVSESAGIKVLIFATCAGMKLSDIESVARAVLPKFYSSDLHSESWRVFSSCGKRCVLTANPRIMVEAFLKDFLGADLVLGTEILTYKGRATGFVQSPGVLVGKNKADALKKAFGKTQPEIGLGDRHTDAPFMALCKEGYIVPPKPEVEAVTTDKLPKPVIFHDGRLVQKPTPLSALLIILWIPIGFILACLRIAAGSLLPMPMVYYAFWALGVRVNIKGTPPPPAKKSIGQSGVLFVCSHRTLLDPIFLSTALGRPIPAVTYSLSRLSEIISPIKTVRLSRDRAADASMIKKLLEEGDLAICPERTTCREPFLLRFSALFAELTDELVPVAMANRMSMFHGTTARGWKGMDPFYFFMNPSPAYEVTFLNKLPLELTLSGGKSSHEVANYIQRVIAATLSYECTSFTRRDKYRALAGNDGNVVEKTKVQANKVMGC

SEQ ID NO: 184 - protein, 501 aa, Populus trichocarpa
MDSFPTVDKCASIGREKHTVVADMDGTLLRGRSSFPYFALLAFEAGGIFRLIFLLLASPLAGLLYYFVSESAGIKVLIFATCAGMKVSDIESVARAVLPKFYSSDLHSESWRVFSSCGKRCVLTANPRIMVEAFLKDFLGADLVLGTEMSTYKGRATGFVQSPGVLVGKNKADALKKAFGMTQPEIGLGDRHTDAPFMALCKEGYIVPPKPEVEAVTTDKLPKPVIFHDGRLVQKPTPLSALLTILWIPIGFILACLRIAAGSLLPMPMVYYAFWALGVRVIIKGTPPPPAKKSIGQSGVLFICSHRTLLDPIFLSTALGRPIPAVTYSVSRLSEIISPIKTVRLSRDRATDASMIKKLLEEGDLAICPEGTTCREPFLLRFSALFAELTDQLVPVAVVNRMSMFHGTTARGWKGMDPFYFFMNPSPAYEVTFLNRLPQELTCTGGKSSHEVANYIQRVIAATLSYECTSFTRRDKYRALAGNDGTVVEKTKLQANKVMGC

SEQ ID NO: 185 - protein, 500 aa, Populus trichocarpa
MVMGAHRHFEPIAKCSTEGRSNQTVAADLDGTLLVSRSAFPYFLLVAIEAGSLLRGLILLSSVPFVYFTYLIISEEMAIKTFIFIAFAGLKIRDIELVSRSVLPKFYADDVHPETWRVFNSFGKRYIVTANPRIMVEPFAKNFLGADKVLGTEIQATKSGRATGFVKKPGVLVGDHKRNALLKEFGTSLPDLGLGDRETDHDFMSICKEGYIVPRSKCEPLPRNKLLSPVIFHEGRLVQRPTPLVALLTFLWMPIGIILSVLRVYLNIPLPERIAWYNYKLLGIRVVVKGNPPPPPRKGQSGVLFVCNHRTVLDPVVTAVALRRKISCVTYSISKFTEIISPIKAVALSRERDRDAANIKRLLEEGDLVICPEGTTCREPFLLRFSALFAELTDRIVPVAINTKQSVFNGTTVRGHKLLDPYFVFMNPMPTYEITFLNQLPTELTCKGGKSSIEVANYIQRVLAGTLGFECTNLTRKDKYAILAGTDGRVATKKEKASEN

SEQ ID NO: 186 - protein, 524 aa, Sorghum bicolor
MERPSPTCLAANGPRRKARTIPFPPPPADLRTGRLRSRQTVAADLDGTLLLSRSAFPYYLLVALEAGSLLRAVALLMSVPFVYLTYVTVSETLAVRAFLYVAVAGLDVSDIEAVARTVLPRFYAGDVHPEGWRVFRSFGRRCVVTASPRVMVEPFARAFLGADVVIGTEMEVGASGKATGFVAGPGVLVGEHKRRAVVREFGDALPDVGMGDRESDFDFMAICKEAYMVTRQKYRALPREQLQSRVILHDGRLARRPTATNTLLTLLWMPLGFALALARVHLHLLLPARALSYAYKLMGVKLVVRGNRPPPPPPSKKGGGPGVLFVCNHRTTLDPVAVAVALGRKVRWVVTDGASSRFSEAVSPVMTGVALPVPVPSRESDDDADAAARIRRLLEEGDDVVIFPEGTICREPFLLRFGALFAEVTDRIVPVAIGAREGMFHGSTARGLRRMDPYFFFMNPRPTYEVTFLNQLPRELTCGGGRSPVEVANYVQEVLAAQLGFDCTCTSKQAKTGWSPAAPTVAWR

SEQ ID NO: 187 - protein, 503 aa, Sorghum bicolor
MVASYRSRRFKPIEECCSEGRSEQTVAADLDGTLLISRSAFPYYLLVALEAGSVLRAVLLLLSVPFVYVTYIFFSESLAISTLVYISVAGLKVRSIEMVARSVLPRFYAGDVHPESWRVFNSFGKRYIITASPRIMVEPFARAFLGADKVVGTELEVGKNGKATGFMVKPGVLVGDHKKKAVVKELGDAVPDVGMGDRETDFDFMSICKEAYLVTSRKYSPVGKNQLLSPLILHDGRLVQRPTPLVALVTFLWMPFGFALALMRVYINLPLPERIVYYTYKLMGIRLIVKGNPPPPPKKGHPGVLFVCNHRTVLDPVEVAVALRRKVSCVTYSISKFSELISPIKAVALSREREKDAENIRRLLEEGDLVICPEGTTCREPFLLRFSALFAELTDRIVPVAINTKESMFHGSTVRGFKLMDPYFFFMNPRPTYEITFLTQLPKDLTCSGGKSPIEVANYIQKTLSGQLGFECTTITRKEKYGILAGTDGRVPSKNKDKEKEKN

SEQ ID NO: 188 - protein, 505 aa, Sorghum bicolor
MAASPFPTVEKCSSTDRSGDTVVADLDGTLLCGRSSFPYFAHMAFETGGVLRLLLLIALAPLAGLLYYFVSEPAGIQVLIFASMAGARVADIEAVARAVLPKFYCADLHPESWRVFSACGRRCVLTANPRIMVEAFLKEYVGTDVVVGTELVVWRGRATGLVRSPGVLVGEQKADALRRTFGDDVAPEVGLGDRKTDYPFMRLCKEGYVVPATPKLKPVPRENLPKPVVFHDGRLVQKPSPALALLTVLWIPIGFLLACLRIAAGALLPMRMVYHAFRALGVRVTIRGNPPPPASRETGQTGVLFICSHRTLLDPIFLSTALGRPITAVTYSVSRLSEILSPIRTVRLTRDRAADAAMIRRLLTEGDLVICPEGTTCREPFLLRFSALFAELTDEIVPVAMENQMSMFHGTTARGWKGLDPFYFFMNPSPGYVVTFLNKLPAELTCNGGGKSSHEVANYIQRLIASTLSYECTNFTRKDKYKALAGNDGTVVSKPNIDKNKVMGC

SEQ ID NO: 189 - protein, 518 aa, Sorghum bicolor
MEEAVEAVVAAGVEPFPTVDKCDASGLGAHSSVVADLDGTLLRSRSAFPYYALVAFETGGVPRLLLLLLLSPLAALLRFLASESACLRVLVFGATAGARVRDVESAARAVLPRFYAADVHPAAWRVFSACSRRRVVLTATPRLFAEPFLRDCLGADAVAGTELATWRGRATGLVDARRGGVLVGRSKAQALREILAADGGDAPDVGLGDSRSDYPFMSMCKEAYIVPRAPVEPALPMDQLPRPVIFHDGRLVRRPTPLVALVVVLWFPVGLALACLRIAAGALLPMPLVYYAFWALGVRVVVRGAPPPPRAERATGRRGVLFACSHRTLLDPIFLSTALGRPVAAVTYSLSRLSEFLSPIRTVRLSRDRATDAAMIRDLLAEGDLVICPEGTTCREPFLLRFSALFAELTSEVVPVAMENRMSMFHGTTARGWKGMDPFYFFMNPSPAYVVTFLNKLPPELTCAGGRTSHEVANYIQRLIAATLSYECTSLTRKDKYRALAGNDGVVATPKPPPTVAS

SEQ ID NO: 190 - protein, 501 aa, Ricinus communis
MPAMKQAQKFPSITSCSGTSYESIAADLDGTLLVSSSSFPYFMLVAVEAGSLLRGLVLLLSLPFIIISYFFISEAIGIQILIFISFAGLKIRDIELVSRAVLPRFYAADVRKESYEVFDRCKRKVVVTANPTIMVEPFVKDFLGGDKVLGTEIEVNPKTKRATGFVKKPGVLVGKWKKLAILKEFGEDAPDLGIGDRKTDHDFMSICKEGYMVYHSKKAATPLPRDRLKSPIIFHDGRFVQRPDPLNALATYLWLPFGFMLSIFRVYFNLPLPERIVRYTYEMLGIHLVIRGYPPPAPSRGTPGNLYVCNHRTALDPIVIAIALGRKVSCVTYSVSRLSRFLSPIPAIALTRDRAADAERITALLQKGDLVVCPEGTTCREQFLLRFSALFAEMSDRIVPVAVNCKQSMFYGTTVRGVKFWDPYFFFMNPRPTYEVTFLDRLPEEMTVKAGGKSSIEVANYVQKVLGDVLGFQCTGLTRKDKYLLLGGNDGKVESMYNSKK

SEQ ID NO: 191 - protein, 512 aa, Ricinus communis
MANPKETYAPFSSFPNIEKCTSVGRQNDTVVTDMDGTLLCGRSPFPYFALVAYEASGILRLLFLLLGSPIAGILRYFISESAGIRVLVFATFAGMRVSDIESVARAVLPKFYSSDLHPETWRVFSSCGKKCVITENPRIMVEAFLKEFVGADMVIGTEIVVHKGRATGFIRSPGVLVGQNKADALKMAFYDAPVPNIGIGDRRTDRPFMKLCKESYIVPSNSQVEPVGPKKLPKPIVFHDGRLVQKPTHLIALATLLWIPVGFILACLRLAAGALLPMPLVYYALWALGVRIHIKGTPPPPAKKSTGQAGVLFVCSHRTLLDPVFLSIALGRPIPAVTYSLSRLSEFISPIKTVRLTRDRVTDANMIKELLQEGDLVICPEGTTCREPFLLRFSALFAELTDELVPVAMANKMTMFHGTTARGWKGMDPFYFLMNPSPAYEVTFLNKLPYNLTCGAGKSSHSVANYIQRTIAATLSYQCTSFTRKDKYRALAGNDGTVVEEPKQARDEVMDS

SEQ ID NO: 192 - protein, 504 aa, Ricinus communis
MVMVDSFPEVSKCASKGREKHTVVADMDGTLFIGRSSFPYFALIAFEAGGIFRLLFLLLASPLAALLYYFVSESAGIQVLIFASFAGMKVSDIESVARAVLPKFYSSDLHPESWRVFSSCGKRCVLTANPRIMVEAFLKDFLGADLVFGTEISTYKGRATGFVRTPGVLVGKNKANALKKAFGDARPEVGLGDRRTDAPFMALCKEGYLVPPKPEVRAVTGDKLPKPIVFHDGRLVQKPTPLMALLIILWIPIGFILACLRIAAGSLLPMPMVYYAFLALGVRVTVKGNPPPPAKKSTGQSGVLFVCSHRTLLDPIFLSTALGRPIAAVTYSVSRLSEIISPIKTVRLSRDRATDAAMIKKLLVEGDLAICPEGTTCREPFLLRFSALFAELTDQIVPVAMVNRMSMFHGTTARGWKGMDPFYFFMNPSPAYEVTFLSKLPQELTCSSGKSSHEVANYIQRVIAATLSYECTGFTRKDKYRALAGNDGSVVEKPKLEANKVMGC

SEQ ID NO: 193 - protein, 498 aa, Arabidopsis lyrata
MSPAKKSGNFPPITECRDGEYDSIAADLDGTLLLSRSSFPYFMLVAVEAGSLFRGLILLLSLPIVIISYLFVSESLGIQILIFISFAGLKIRDIELVSRAVLPRFYAADVRKDSFDVFDKCKRKVVVTANPIVMVEAFVKDYLGGDKVLGTEIEVNPKSNRATGFVKKPGVLVGDLKRLAILKEFGDESPDLGLGDRTSDHDFMSLCKKGYMVHACKSATTIPKERLKNRIVFHDGRLAQRPTPLNAIVTYLWLPFGFILSIIRVYFNLPLPERFVRYTYEILGIHLTIRGHRPPPPSPGTLGNLYVLNHRTALDPIIVAIALGRKICCVTYSVSRLSLMLSPIPAVALTRDRVTDAANMRKLLEKGDLVICPEGTTCREEYLLRFSALFSELSDRIVPVAMNCKQGMFNGTTVRGVKFWDPYFFFMNPRPSYEATFLDRLPEEMTVNGGGKTPIEVANYVQKVIGAVLGFECTELTRKDKYLLLGGNDGKVESIMLG

SEQ ID NO: 194 - protein, 501 aa, Arabidopsis lyrata
MGAQEKRRRFEPISKCDVKDRSNHTVAADLDGTLLISRSAFPYYFLVALEAGGLLRALILLVSVPFVYLTYLTVSETLAINVFVFITFAGLKIRDVELVVRSVLPRFYAEDVRPDTWRIFNTFGKRYIVTASPRIMVEPFVKTYLGVDKVLGTELEVSKSGRATGFTRKPGILVGQHKREVVLREFGSLASDLPDLGLGDSKTDYDFMSICKEGYMVPRTKCEPLPRNKLLSPIIFHEGRLVQRPTPLVALLTLLWLPIGFLLSLIRVYTNIPLPERIARYNYKLTGIKLIVNGHPPPPPKPGQPGHLLVCNHRTVLDPVVTAVALGRKISCVTYSISKFSELISPIKAVALTRQREKDAANIKRLLEEGDLVICPEGTTCREPFLLRFSALFAELTDRIVPVAINTKQSMFNGTTTRGYKLLDPYFAFMNPRPTYEITFLKQIPAELTCKGGKSPIEVANYIQRVLGGTLGFECTNFTRKDKYAMLAGTDGRVPVKKEKT

SEQ ID NO: 195 - protein, 502 aa, Vernicia fordii
MSQTKPAPKFPSITSCTGSAYQSIAADLDGTLLVSSSSFPYFMLVAVEAGSLLRGLVSLLSLPLVIISYFFISEAVGIQILIYISFAGLKIRDIELVSRAVLPRFYAADVRKESFEVFDKCKRKVVVTANPTIMVEPFVKDFLGGDKVLGTEIEVNPKTKRATGFVKNPGVLVGKWKKLSILKEFGEESPDLGIGDRKTDHDFMSICKEGYMVQRSKSATPIPLDRLKSRIIFHDGRFVQRPDPLNALVTYLWLPFGFILSIIRVYFNLPLPERIVRYTYEMLGIHLVIRGNPPPAPSPGTPGNLYVCNHRSALDPIVIAIALGRKVSCVTYSVSRLSRFLSPIPAIALTRDRAADAARISELLQKGDLVVCPEGTTCREPFLLRFSALFAEMSDRIVPVAVNCKQNMFYGTTVRGVKFWDPYYFFMNPRPTYEVTFLDRLPEEMTAKAGGKSSIEVANYVQKVLGDVLGFECTGLTRKDKYMLLGGNDGKVESMYNTKKAG

SEQ ID NO: 196 - protein, 514 aa, Oryza sativa
MGDATMIASPFPAVEKCSSKDRGGDTIVADLDGTLLCGRSSFPYFAHMAFETGGVLRLLALILLAPLAGVLYYLVSESAGIQVLIFASMAGARVADVEAVARAVLPKFYCSDIHPESWRVFSACGRRCVLTANPRMMVEAFLKEYLGADIVVGTELVVWRGRATGLVRSPGVLVGENKAAALREAFGDASPEIGIGDRRTDYPFMRLCKEGYVVPVSPTPRPVPREELPKPVVFHDGRLVQKPSPALALLTVLWIPIGFVLACLRIAAGALLPMRVVYHAFRALGVRVTVKGTPPPPASRETGQSGVLFICSHRTLLDPIFLSTALGRPITAVTYSVSRLSEILSPIRTVRLTRDRAADAAMIRRLLAEGDLVICPEGTTCREPFLLRFSALFAELTDEIVPVAMENQMSMFHGTTARGWKALDPFYFFMNPSPGYVVTFLSKLPGELTCNGGGGGGGGRSSHEVANYIQRLIASTLSYECTSFTRKDKYRALAGNDGTVVSKPNIDEKKAMGC

SEQ ID NO: 197 - protein, 503 aa, Brassica napus
MSPAKKKSRSFPPISECKRGEYDSIAADLDGTMLLSRSSFPYFMLVAIEAGSLFRGLILLLSLPIVIIAYLFVSEALGIQILIYISFAGIKIRDIELVSRAVLPRFYAADVRKDSFEVFDKCKRKVVVTANPIVMVEPFVKDYLGGDKVLGTEIEVNPKTMKATGFVKKPGVLVGDLKRLAILKEFGEESPDLGLGDRTSDHDFMSICKEGYMVHESKSATTVPIERLKNRIIFHDGRLVQRPTPLNAIIIYLWLPFGFMLSIFRVYFNLPLPERFVRYTYEILGIHLTIRGHRPPPPSPGTPGNLYVLNHRTALDPIIIAIALGRKISCVTYSVSRLSRMLSPIPAVALTRDRAADAARMRKLLEKGDLVICPEGTTCREPYLLRFSALFAELSDRIVPVAMNCKQGMFNGTTVRGVKFWDPYFFFMNPRPSYEATFLDRLPEEWTVNGGGKTPIEVANYVQKVIGGVLGFECTELTRKDKYLLLGGNDGKVESINKSKAKE

SEQ ID NO: 198 - protein, 500 aa, Populus trichocarpa
MSPTKPAKKFPPITACNGTTHQSIAADLDGTLLVSSSSFPYFMIVAVEAGSLFRGLVLLLSLPIVIVSYLFISEALGIQMLIFISMSGLKIRDIELVSRAVLPRFYAADVRSESFEVFDRCKRKVVVTANPTIMVEPFVKDFLGGDKVLGTEIEVNPKTKRATGFVKKPGVLVGKWKELAVLKEFGEEAPDLGIGDRKTDHDFMSLCKEGYMVHRSKSATPLPRDRLKNRIIFHDGRLVQRPDPLNALITYIWLPFGFILSIIRVYFNLPLPERIVRYTYEMLGIHLVIRGTPPPAPSPGTPGNLYVCNHRTALDPIVIAIALGRKVSCVTYSVSRLSRFLSPIPAIALTRDRAADAARISSILQKGDLVVCPEGTTCREEFLLRFSALFAELSDRIVPVAVNCKQNMFYGTTVRGVKFWDPYFFFMNPRPTYEVTFLDRLPEEMTVKAGGKSSIEVANYVQKVLGEVLGFENTGLTRKDKYLLLGGNDGKVESMHNAKK

SEQ ID NO: 199 - protein, 518 aa, Sorghum bicolor
MAPAASARFPPVSSYDASARTRRTAAADLDGTLLASSSAFPYYFLVALEAGSCLRAAALLLVAPLLLALYTLVSEAAAIALLAFVTFAGLRVRDVEAVARGVLPRHYAAGVRADTWTVFRGCGEGRRVVVTASPAVMVGEFVREFLGAEVAGTELETFSAFGAARFTGRIKAVLVGERKAEVVRRLFAGGEMPDVGLGDRESDHDFMAICKEAYMVPPDKRAARAAADTLLSRSVFHDGRLVQRPDPAQALFALAYLPLGFLLALFRVFFNLMMPLRLVRHTYRLTGIRLRVRGTPPPPPAPGAPGSLLVCNHRTALDPIILSVALGRPVSCVTYSASRLSTAISPIRAVALSRDRATDAARMAALLAEGDVVVCPEGTTCREPCLLRFSALFAELTDRIVPVAMEARQGTYYGSTARGWKWLDPYFFYMNPRPGYDVTFLPPLRPEETCGAGGRSAVDVANHVQRVIAKELGFQCTTLTRKDKYMKLAGNDGSVAARAKKDAADDNAATVTTTKKFV

SEQ ID NO: 200 - protein, 293 aa, Ricinus communis
MSICKEGYMVPRTKCEPLPRNKLLSPVIFHEGRLVQRPTPLVALLTFLWMPIGIILSILRVYLNIPLPERIAYYNYKILGIKVIVKGTPPPAPRKGQSGVLFVCNHRTVLDPVVTAVALGRKISCVTYSISKFTEIISPIKAVALSREREKDAANIKRLLEEGDLVICPEGTTCREPFLLRFSALFAELTDRIVPVAINTKQTVFHGTTVRGHKLLDPYFVFMNPMPTYEITFLNQLPIELTCKGGKSSIEVANYIQRVLAGTLGFECTNLTRKDKYAILAGTDGRVPSKKEK

SEQ ID NO: 201 - protein, 502 aa, Arabidopsis lyrata
MSPAKKSRSFPPISECKSREYDSIAADLDGTLLLSRSSFPYFMLVAIEAGSLFRGLILLLSLPIVIIAYLFVSESLGIQILIYISFAGIKIKNIELVSRAVLPRFYAADVRKDSFEVFDKCKRKVVVTANPIVMVEPFVKDYLGGEKVLGTEIEVNPKTMKATGFVKKPGVLVGDLKRLAILKEFGEESPDIGLGDRTSDHDFMSICKEGYMVHETKSATTVPIERLKNRIIFHDGRLVQRPTPLNALIIYLWLPFGFMLSIFRVYFNLPLPERFVRYTYEILGIHLTIRGHRPPPPSPGKPGNLYVLNHRTALDPIIIAIALGRKITCVTYSVSRLSLMLSPIPAVALTRDRVADAARMRQLLEKGDLVICPEGTTCREPYLLRFSALFAELSDRIVPVAMNCKQGMFNGTTVRGVKFWDPYFFFMNPRPSYEATFLDRLPEEMTVNGGGKTPFEVANYVQKVIGGVLGFECTELTRKDKYLLLGGNDGKVESINKTKSMD

SEQ ID NO: 202 - protein, 585 aa, Arabidopsis thaliana
MVLPELLVILAEWVLYRLLAKSCYRAARKLRGYGFQLKNLLSLSKTQSLHNNSQHHLHNHHQQNHPNQTLQDSLDPLFPSLTKYQELLLDKNRACSVSSDHYRDTFFCDIDGVLLRQHSSKHFHTFFPYFMLVAFEGGSIIRAILLLLSCSFLWTLQQETKLRVLSFITFSGLRVKDMDNVSRSVLPKFFLENLNIQVYDIWARTEYSKVVFTSLPQVLVERFLREHLNADDVIGTKLQEIKVMGRKFYTGLASGSGFVLKHKSAEDYFFDSKKKPALGIGSSSSPQDHIFISICKEAYFWNEEESMSKNNALPRERYPKPLIFHDGRLAFLPTPLATLAMFIWLPIGFLLAVFRISVGVFLPYHVANFLASMSGVRITFKTHNLNNGRPEKGNSGVLYVCNHRTLLDPVFLTTSLGKPLTAVTYSLSKFSEFIAPLKTVSLKRDRKKDGEAMQRLLSKGDLVVCPEGTTCREPYLLRFSPLFAELTEDIVPVAVDARVSMFYGTTASGLKCLDPIFFLMNPRPVYCLEILKKLPKEMTCAGGKSSFEVANFIQGELARVLGFECTNLTRRDKYLVLAGNEGIVR

SEQ ID NO: 203 - protein, 520 aa, Arabidopsis thaliana
MSAKISIFQALVFLFYRFILRRYRNSKPKYQNGPSSLLQSDLSRHTLIFNVEGALLKSDSLFPYFMLVAFEAGGVIRSFLLFILYPLISLMSHEMGVKVMVMVSFFGIKKEGFRAGRAVLPKYFLEDVGLEMFEVLKRGGKKIGVSDDLPQVMIEGFLRDYLEIDVVVGREMKVVGGYYLGIMEDKTKHDLVFDELVRKERLNTGRVIGITSFNTSLHRYLFSQFCQEIYFVKKSDKRSWQTLPRSQYPKPLIFHDGRLAIKPTLMNTLVLFMWGPFAAAAAAARLFVSLCIPYSLSIPILAFSGCRLTVTNDYVSSQKQKPSQRKGCLFVCNHRTLLDPLYVAFALRKKNIKTVTYSLSRVSEILAPIKTVRLTRDRVSDGQAMEKLLTEGDLVVCPEGTTCREPYLLRFSPLFTEVSDVIVPVAVTVHVTFFYGTTASGLKALDPLFFLLDPYPTYTIQFLDPVSGATCQDPDGKLKFEVANNVQSDIGKALDFECTSLTRKDKYLILAGNNGVVKKN

SEQ ID NO: 204 - DNA, 1330 bp, Arabidopsis thaliana
agttaaaagattggttatttgggctctgcactcaagtgagagagaagatagatagatctgagtagaatcttcgattcattattcgttgtcgtcgttcatctgtgagaagcggacaaaccaaagaatccaccggagctagtgatatgggtggttccagagagttccgagctgaggaacattcaaatcaattccactctatcatcgccatggccatctggcttggcgccattcacttcaacgtcgctcttgttctctgttctctcattttccttcctccttctctatctctcatggtcttgggcttgctctctctgtttatctttatcccaatcgatcatcgtagcaaatatggtcgtaagctcgctaggtacatatgcaagcacgcgtgtaattatttccccgtctctctgtacgtcgaggattacgaagctttccagcctaatcgtgcctatgtctttggttatgaaccacattcggtgctaccgattggagttgttgctctttgtgatctcacagggtttatgcctattcctaacattaaagttcttgcaagtagtgctatattctacactccctttctaaggcatatatggacatggttagggctcaccgctgcttctaggaagaatttcacttcccttttggattctggctacagttgtgttcttgtacctggtggtgtgcaggagacttttcatatgcaacatgatgctgagaatgtcttcctttcaaggagaagaggatttgtgcgcatagccatggaacaggggagccctctggttccagtattctgctttggtcaggcacgcgtgtacaaatggtggaagccggattgtgatctctatcttaaactatctagagcaatcagattcaccccgatctgcttctggggagtttttggatcaccattaccgtgtcgacagcctatgcatgtggtcgttggtaaaccaatagaagtcacaaaaactctgaagccaactgacgaagagattgctaagtttcatggccagtatgtggaagcgcttagggatctgtttgagaggcacaagtcccgagtcggctatgatcttgagctgaaaattctttgaacaaaatctccaatggaaataattacttgtgtgtatccttcattaattgttaccttggagctggatttggacttaatataaatgactacatcatgtagtctacatgtattgcatgtctttagcatcgactgttgaagtaatggaatacgtttataaagcctgtaaattacatgtcgtcttgcacaagagtatgtggtaataataacatttgacccaaaaataatactagttaaatttttcct

SEQ ID NO: 205 - DNA, 1381 bp, Ricinus communis
  misc_feature (1347)..(1347): n is a, c, g, or t
actggagcacgaggacactgacatggactgaaggagtagaaaagggacgcaaaaaaagattttacatggcggagaggtcgatgctgctttattttcattaatacagaaagagtttgagcactgagcactgaatagcaagaagaagaagaagaagaaatgggggaagaagcgaatcataataataataataataatatcaatagtaatgatgagaagaatgaagagaaatcaaattatacagttgtaaattcgagagaactatacccaacgaacatatttcacgcactgttagcgttgagcatatggattggttcaatccatttcaatctcttcttactcttcatctcttatctcttcctttcttttcccacattcctcctgattgttggattttttgtggtgttaatgttcattccgatcgacgaacacagtaagttgggccgtcgtttgtgcaggtatgtatgcagacatgcgtgcagtcattttccggtaactctccatgttgaagacatgaatgcttttcattctgatcgtgcttacgtttttggttatgagccacattcagtatttccccttggtgtttctgtactatcagatcactttgctgtcctgccccttcctaaaatgaaggtccttgcaagtaacgctgtgtttcggacaccagttttaaggcatatatggacatggtgtggtcttacatcagcaacaaagaaaaatttcactgccctcctagcatctggttatagttgcattgtgattcccggtggagttcaagagacattttatatgaagcatggctctgagattgctttccttaaggcgagaagagggtttgtccgagtagctatggagatgggtaaacccttggttccagttttctgctttggtcaatcgaacgtgtacaagtggtggaaacctgatggcgagttatttatgaaaattgctagagctattaagttcagcccaattgtcttttggggagttctcggttctcatttaccgctacaacgtccaatgcatgttgtcgtcggtaaaccgattgaggtgaagcaaaatccacagcctacagtggaagaggtctcagaagtacagggtcagtttgttgcggcacttaaagatctttttgaaaggcataaagcacgggttggctatgcagaccttacacttgaaattctttgatagaagtcagtacttgttttagttcagttggatgcctctttcagtttttggcgataatgtttgtattcattagataattaggaaaatgaaatgtaaaacggtgaataaagcttttcaatatgcgggcatcacaaagttgttctagatatccaaaaaaaaaaaaaaacnctgtatgccgttacgtaccgtatcgttgacagca

SEQ ID NO: 206 - DNA, 1257 bp, Vernicia fordii
agaagggcgatgcacatgatactctcctcttaataagagtattgatacccagagaagccagaagcaagaaacaaacaacttttgcaagaaggagattaaaatggggatggtggaagttaagaatgaagaagaggttaccatattcaaatctggagaaatatacccaacaaacatttttcaatcagtgttagctttggctatatggcttggctctttccatttcatcctcttcttagtctcttcttcaatcttccttcctttctccaaatttctcctcgttattgggttgcttttgttttttatggtgattcctatcaacgatcgcagtaagcttggccaatgcttgttcagctatatatctaggcatgtttgcagctattttcccatcactcttcatgttgaagatataaatgcctttcgttctgatcgtgcttacgtgtttggttatgagccacattcagtttttcccattggtgtgatgattctttctttgggtttaattcctcttcctaatataaaattccttgcaagtagtgctgtgttctacactccatttttaagacatatatggtcatggtgtggtcttacaccagcaacaaggaaaaattttgtttccctcctgtcttctggttatagttgcattctggtgcctggtggagtccaagagacattttatatgaagcaggactctgagattgctttccttaaggcaagaagaggatttattcgaatagctatgcagacgggcacacccttggttcctgttttctgctttggtcaaatgcacacattcaaatggtggaaacctgatggagagttgttcatgaaaattgctagagctattaaattcaccccaactatcttttggggagttctcggaactcctttacccttcaaaaatccaatgcatgtcgtggtgggtagacccattgaggtgaagcaaaatccacagcctaccgctgaagaggttgcggaagtacagagagagtttattgcatcacttaaaaatctctttgaaaggcacaaagcacgggtcggctattcagaccttaaacttgaaattttttgaccagaaatcagaacttaaaagtagttttgcatgctttctcattttcatttatttagtttttttttaaacctttttttttcccttttgttaatttgtgttcttagataatgatgaaaatgagaaaaaaaaaaaatttgtaaaacagctaataagccttaattttgtggcaaaaaaaaaaaaaaaaaaaa

SEQ ID NO: 207 - DNA, 1280 bp, Mortierella ramanniana
  misc_feature (1265)..(1266): n is a, c, g, or t
  misc_feature (1269)..(1269): n is a, c, g, or t
  misc_feature (1275)..(1275): n is a, c, g, or t
  misc_feature (1277)..(1277): n is a, c, g, or t
  misc_feature (1279)..(1279): n is a, c, g, or t
tgcaaagtcacactttcagtcagccatggccagcaaggatcaacatttacagcagaaggtcaagcatacgctagaagctatcccatcccctcgctatgctccattgcgagtgccattaagacggagattacaaacattggcagttttattatggtgttccatgatgtcaatatgcatgttcatattcttctttttatgctccattcctgttctcctttggttccccattatcctttatttgacctggatcttggtgtgggataaggcgccagagaacggtggaagacctattcgctggctgcggaatgctgcttggtggaagctgtttgcagggtattttcccgcacatgtcatcaaggaagccgatttagatccatccaagaactacatctttggttatcacccccatggaatcatatccatgggctcgttctgtacttttagtaccaatgctactggctttgatgacttgttcccaggcatccggccatcgcttttgacattaacatctaattttaatatcccactttatcgtgattatttgatggcgtgcggactttgctccgtctccaaaacatcctgtcaaaatattttaaccaaaggtggtccgggccgttccattgccattgtcgtgggaggtgcttccgagtctctcaatgctagacccggtgtcatggaccttgtgttgaagagacgctttggttttatcaagattgctgttcaaaccggtgcaagtctagtgcccactatcagttttggtgaaaatgagctgtacgaacagattgaaagcaatgaaaactcaaagttgcatagatggcaaaagaagattcaacatgcccttggttttactatgccgctctttcatggacgcggtgtattcaattatgactttggtttgctcccccatcgccatcctatctacacgattgttggaaagcccatccccgtccctagcatcaagtatggacagacaaaggatgagattataagagaactacatgactcgtacatgcatgccgtgcaggatctctatgatcgttacaaggatatctatgcaaaggatcgggtaaaagaactagaattcgtcgaatagttgggttgttaccatttaacgttttcttcaaatttttcattgattataccgcttcatcccgacctggttttttattgaatgggtttctcatctccagttcaattcccactcctgcatgtatctattatcatcatcctttctaataatgaaaaccttttgaacgtttcataannaanagaaananana

SEQ ID NO: 208 - DNA, 2485 bp, Homo sapiens
tgccccgttgtgaggtgataaagtgttgcgctccgggacgccagcgccgcggctgccgcctctgctggggtctaggctgtttctctcgcgccaccactggccgccggccgcagctccaggtgtcctagccgcccagcctcgacgccgtcccgggacccctgtgctctgcgcgaagccctggccccgggggccggggcatgggccaggggcgcggggtgaagcggcttcccgcggggccgtgactgggcgggcttcagccatgaagaccctcatagccgcctactccggggtcctgcgcggcgagcgtcaggccgaggctgaccggagccagcgctctcacggaggacctgcgctgtcgcgcgaggggtctgggagatggggcactggatccagcatcctctccgccctccaggacctcttctctgtcacctggctcaataggtccaaggtggaaaagcagctacaggtcatctcagtgctccagtgggtcctgtccttccttgtactgggagtggcctgcagtgccatcctcatgtacatattctgcactgattgctggctcatcgctgtgctctacttcacttggctggtgtttgactggaacacacccaagaaaggtggcaggaggtcacagtgggtccgaaactgggctgtgtggcgctactttcgagactactttcccatccagctggtgaagacacacaacctgctgaccaccaggaactatatctttggataccacccccatggtatcatgggcctgggtgccttctgcaacttcagcacagaggccacagaagtgagcaagaagttcccaggcatacggccttacctggctacactggcaggcaacttccgaatgcctgtgttgagggagtacctgatgtctggaggtatctgccctgtcagccgggacaccatagactatttgctttcaaagaatgggagtggcaatgctatcatcatcgtggtcgggggtgcggctgagtctctgagctccatgcctggcaagaatgcagtcaccctgcggaaccgcaagggctttgtgaaactggccctgcgtcatggagctgacctggttcccatctactcctttggagagaatgaagtgtacaagcaggtgatcttcgaggagggctcctggggccgatgggtccagaagaagttccagaaatacattggtttcgccccatgcatcttccatggtcgaggcctcttctcctccgacacctgggggctggtgccctactccaagcccatcaccactgttgtgggagagcccatcaccatccccaagctggagcacccaacccagcaagacatcgacctgtaccacaccatgtacatggaggccctggtgaagctcttcgacaagcacaagaccaagttcggcctcccggagactgaggtcctggaggtgaactgagccagccttcggggccaattccctggaggaaccagctgcaaatcacttttttgctctgtaaatttggaagtgtcatgggtgtctgtgggttatttaaaagaaattataacaattttgctaaaccattacaatgttaggtcttttttaagaaggaaaaagtcagtatttcaagttctttcacttccagcttgccctgttctaggtggtggctaaatctgggcctaatctgggtggctcagctaacctctcttcttcccttcctgaagtgacaaaggaaactcagtcttcttggggaagaaggattgccattagtgacttggaccagttagatgattcactttttgcccctagggatgagaggcgaaagccacttctcatacaagcccctttattgccactaccccacgctcgtctagtcctgaaactgcaggaccagtttctctgccaaggggaggagttggagagcacagttgccccgttgtgtgagggcagtagtaggcatctggaatgctccagtttgatctcccttctgccacccctacctcacccctagtcactcatatcggagcctggactggcctccaggatgaggatgggggtggcaatgacaccctgcaggggaaaggactgccccccatgcaccattgcagggaggatgccgccaccatgagctaggtggagtaactggtttttcttgggtggctgatgacatggatgcagcacagactcagccttggcctggagcacatgcttactggtggcctcagtttaccttccccagatcctagattctggatgtgaggaagagatccctcttcagaaggggcctggccttctgagcagcagattagttccaaagcaggtggcccccgaacccaagcctcacttttctgtgccttcctgagggggttgggccggggaggaaacccaaccctctcctgtgtgttctgttatctcttgatgagatcattgcaccatgtcagacttttgtatatgccttgaaaataaatgaaagtgagaatcctcaaaaaaaaaaaaaaaaaaaaaaaaaaaaaaaaa

SEQ ID NO: 209 - DNA, 1411 bp, Homo sapiens
actgttctgagatctttgcctccctcaggctcccgagaatcatggctcattccaagcagcctagtcacttccagagtctgatgcttctgcagtggcctttgagctaccttgccatcttttggatcttgcagccattgttcgtctacctgctgtttacatccttgtggccgctaccagtgctttactttgcctggttgttcctggactggaagaccccagagcgaggtggcaggcgttcggcctgggtaaggaactggtgtgtctggacccacatcagggactatttccccattacgatcctgaagacaaaggacctatcacctgagcacaactacctcatgggggttcacccccatggcctcctgacctttggcgccttctgcaacttctgcactgaggccacaggcttctcgaagaccttcccaggcatcactcctcacttggccacgctgtcctggttcttcaagatcccctttgttagggagtacctcatggccaaaggtgtgtgctctgtgagccagccagccatcaactatctgctgagccatggcactggcaacctcgtgggcattgtagtgggaggtgtgggtgaggccctgcaaagtgtgcccaacaccaccaccctcatcctccagaagcgcaaggggttcgtgcgcacagccctccagcatggggctcatctggtccccaccttcacttttggggaaactgaggtgtatgatcaggtgctgttccataaggatagcaggatgtacaagttccagagctgcttccgccgtatctttggtttctactgttgtgtcttctatggacaaagcttctgtcaaggctccactgggctcctgccatactccaggcctattgtcactgtggttggggagcctctgccactgccccaaattgaaaagccaagccaggagatggtggacaaataccatgcactttatatggatgctctgcacaaactgttcgaccagcataagacccactatggctgctcagagacccaaaagctgtttttcctgtgaatgaaggtactgcatgcccaggagcacaggagtgcctgccttgaagaagagactcatctgccactaaccaaagacaggcaggagatgagggaggttatatgtggtaggggagggcatgaggaattccttctttgccttcttgccacagggtccttacaggaattctttctgaagagctgcacacagtcattcctcaaaggagggcatcctagtgcccctcatgctggggcctgatgcctggtcatcatttgagtcctctgggacacattagcagtcactgcatattcccccagcccctgggcaactatctactttctgtctctgtggatttgccaattctgaacattttatataaatggaataatacaataaaaaaaaaaaaa

SEQ ID NO: 210 - DNA, 2488 bp, Bos taurus
gccgtggccgtggccaaggctccgctttccgccggtgctccggcccgtctggcggcccgtccctccgcaccctcggccgtagcggtccccgcgctcccctgctcggcgcgaagccctggccccggcggccggggcatgggccaggggcgcggggtctggcggcttcccgcggggccccgacctgtactggcttcgtcatgaagaccctcatagccgcctactccggggtcctgcgaggcactggctccagcatcctctctgccctccaggacctgttttctgtcacttggctcaataggtccaaggtagagaagcagctccaagtcatctcggtgctacaatgggtcctgtctttcctcgtgctgggagtggcctgcagcgtcatcctcatgtacacattctgcaccgattgctggctcattgccgtgctctacttcacctggctggtgtttgactggaacacacccaagaaaggtggcaggaggtcacagtgggtccgaaactgggctgtgtggcgctactttcgagactactttcccattcagctggtgaagacacacaacttactgaccagcaggaactacatctttgggtaccatccccatggcatcatgggcctgggtgccttctgcaacttcagcacagaggccacagaagtaagcaagaagttccctggcataaggccctacctggccacgctggccggcaacttccggatgccagtgctgcgggagtacctgatgtctggaggcatctgcccagtgaaccgggacaccatagactacttgctttcaaagaatgggagtggcaatgccatcatcatcgtggtggggggcgcggctgaatccctgagctccatgcccggcaagaatgcagtcaccctgcgcaatcgcaagggctttgtgaaactggccctgcgccatggagccgacctggttcccacctactcctttggggagaatgaggtgtacaagcaggtgatctttgaggagggctcctggggccggtgggtgcagaagaagttccagaagtacattggctttgccccatgcatcttccatggtcgaggcctcttctcctctgacacctgggggctggtgccctactccaagcccatcaccactgtcgtgggcgagcccattaccatccccaggctggagcgcccgacgcagcaggacatcgacctgtaccacgccatgtacgtgcaagccctggtgaagctcttcgaccagcataagaccaagttcggcctcccggagaccgaggtcctggaggtgaactgagcctgtctgcaggggccagcttctgggaggaaccatctgcaaatcgttttctaccaagttctcaagtgctttttgttctgtaaatttggaagcatcatgggtgtctgtgggttatttaaaagaaattataataattttgttaaaccgttacaatgttaggtcttttttaagaaggagaaagggaatatttcaagctctctcagttccagtttgtcctgttccaggtgggcgctgccacatctgggcctttatggtttcacaacccctcttctctcctcccccaaattacagagaaaattcagtcctggttaactggggaagaaggacagtcattagtgactcgggccagttagattatttgccctttggccctgagggatgaggggcagaagcctcctctagtacaaacatctctatgcccagctacccaaggcttgactgcaggactaaaccctcttgccaaggaaagacacagaggaaacaggtgttcccatgctgaagagtgcagggataagcacctggaatattcaagcttgattctcctttctgccacccccatggccccagtctctgaaatctgagcctggactggcctccaaagagaggatcagggtggcagtgttcctgtgctggagaatggagctgtccagatgaaccatctcttgggttatcaagccccatcatgttctggttggagtgactggttttcctcagggggctgatgacacagacccagacccagcacagaccctgccttggcctgccagtggcctcgctttgcttaacccacatcctcagcagtggatgcgaggaaggggtcccctttcctgtttacagaggggcctgagcagtagactggtaccagaacagaagttccccgaacccaaacctcatgtatttgtgccttttctgagaggggggccaggggggacagctagtactctgtgtactctgctttctcttgatgagatcattataccatgtcagactttcgtatattcctaaatggataaatgaaaacaagtgtcctctatgagttattgttagggtcacattagcatcttgctgctgatgattggggagaccactgccccagctgggctgcctgctaagccctctcccactttctccttcagcccaaatggccctttgtatattagttatcaattgctgtgtaataaattactccaaaacttggtggctgc

SEQ ID NO: 211 - DNA, 1330 bp, Mus musculus
ggtcaggggcgcggcgtgaggcggctttctgcacggccgtgacgtgcattggcttcagcatgaagaccctcatcgccgcctactccggggtcctgcggggtgagcgtcgggcggaagctgcccgcagcgaaaacaagaataaaggatctgccctgtcacgcgaggggtctgggcgatggggcactggctccagcatcctctcagccctccaagacatcttctctgtcacctggctcaacagatctaaggtggaaaaacagctgcaggtcatctcagtactacaatgggtcctatccttcctggtgctaggagtggcctgcagtgtcatcctcatgtacaccttctgcacagactgctggctgatagctgtgctctacttcacctggctggcatttgactggaacacgcccaagaaaggtggcaggagatcgcagtgggtgcgaaactgggccgtgtggcgctacttccgagactactttcccatccagctggtgaagacacacaacctgctgaccaccaggaactatatctttggataccacccccatggcatcatgggcctgggtgccttctgtaacttcagcacagaggctactgaagtcagcaagaagtttcctggcataaggccctatttggctacgttggctggtaacttccggatgcctgtgcttcgcgagtacctgatgtctggaggcatctgccctgtcaaccgagacaccatagactacttgctctccaagaatgggagtggcaatgctatcatcatcgtggtgggaggtgcagctgagtccctgagctccatgcctggcaagaacgcagtcaccctgaagaaccgcaaaggctttgtgaagctggccctgcgccatggagctgatctggttcccacttattcctttggagagaatgaggtatacaagcaggtgatctttgaggagggttcctggggccgatgggtccagaagaagttccagaagtatattggtttcgccccctgcatcttccatggccgaggcctcttctcctctgacacctgggggctggtgccctactccaagcccatcaccaccgtcgtgggggagcccatcactgtccccaagctggagcacccgacccagaaagacatcgacctgtaccatgccatgtacatggaggccctggtgaagctctttgacaatcacaagaccaaatttggccttccagagactgaggtgctggaggtgaactgacccagcccgcgcgtgccagctcctgggagggacgactgcagatccttttctaccgagttctcgagtgcattttgttctgtaaatttggaagcgtcatgggtgtc

SEQ ID NO: 212 - protein, 314 aa, Arabidopsis thaliana
MGGSREFRAEEHSNQFHSIIAMAIWLGAIHFNVALVLCSLIFLPPSLSLMVLGLLSLFIFIPIDHRSKYGRKLARYICKHACNYFPVSLYVEDYEAFQPNRAYVFGYEPHSVLPIGVVALCDLTGFMPIPNIKVLASSAIFYTPFLRHIWTWLGLTAASRKNFTSLLDSGYSCVLVPGGVQETFHMQHDAENVFLSRRRGFVRIAMEQGSPLVPVFCFGQARVYKWWKPDCDLYLKLSRAIRFTPICFWGVFGSPLPCRQPMHVVVGKPIEVTKTLKPTDEEIAKFHGQYVEALRDLFERHKSRVGYDLELKIL

SEQ ID NO: 213 - protein, 340 aa, Ricinus communis
MGEEANHNNNNNNINSNDEKNEEKSNYTVVNSRELYPTNIFHALLALSIWIGSIHFNLFLLFISYLFLSFPTFLLIVGFFVVLMFIPIDEHSKLGRRLCRYVCRHACSHFPVTLHVEDMNAFHSDRAYVFGYEPHSVFPLGVSVLSDHFAVLPLPKMKVLASNAVFRTPVLRHIWTWCGLTSATKKNFTALLASGYSCIVIPGGVQETFYMKHGSEIAFLKARRGFVRVAMEMGKPLVPVFCFGQSNVYKWWKPDGELFMKIARAIKFSPIVFWGVLGSHLPLQRPMHVVVGKPIEVKQNPQPTVEEVSEVQGQFVAALKDLFERHKARVGYADLTLEIL

SEQ ID NO: 214 - protein, 322 aa, Vernicia fordii
MGMVEVKNEEEVTIFKSGEIYPTNIFQSVLALAIWLGSFHFILFLVSSSIFLPFSKFLLVIGLLLFFMVIPINDRSKLGQCLFSYISRHVCSYFPITLHVEDINAFRSDRAYVFGYEPHSVFPIGVMILSLGLIPLPNIKFLASSAVFYTPFLRHIWSWCGLTPATRKNFVSLLSSGYSCILVPGGVQETFYMKQDSEIAFLKARRGFIRIAMQTGTPLVPVFCFGQMHTFKWWKPDGELFMKIARAIKFTPTIFWGVLGTPLPFKNPMHVVVGRPIEVKQNPQPTAEEVAEVQREFIASLKNLFERHKARVGYSDLKLEIF

SEQ ID NO: 215 - protein, 355 aa, Mortierella ramanniana
MASKDQHLQQKVKHTLEAIPSPRYAPLRVPLRRRLQTLAVLLWCSMMSICMFIFFFLCSIPVLLWFPIILYLTWILVWDKAPENGGRPIRWLRNAAWWKLFAGYFPAHVIKEADLDPSKNYIFGYHPHGIISMGSFCTFSTNATGFDDLFPGIRPSLLTLTSNFNIPLYRDYLMACGLCSVSKTSCQNILTKGGPGRSIAIVVGGASESLNARPGVMDLVLKRRFGFIKIAVQTGASLVPTISFGENELYEQIESNENSKLHRWQKKIQHALGFTMPLFHGRGVFNYDFGLLPHRHPIYTIVGKPIPVPSIKYGQTKDEIIRELHDSYMHAVQDLYDRYKDIYAKDRVKELEFVE

SEQ ID NO: 216 - protein, 388 aa, Homo sapiens
MKTLIAAYSGVLRGERQAEADRSQRSHGGPALSREGSGRWGTGSSILSALQDLFSVTWLNRSKVEKQLQVISVLQWVLSFLVLGVACSAILMYIFCTDCWLIAVLYFTWLVFDWNTPKKGGRRSQWVRNWAVWRYFRDYFPIQLVKTHNLLTTRNYIFGYHPHGIMGLGAFCNFSTEATEVSKKFPGIRPYLATLAGNFRMPVLREYLMSGGICPVSRDTIDYLLSKNGSGNAIIIVVGGAAESLSSMPGKNAVTLRNRKGFVKLALRHGADLVPIYSFGENEVYKQVIFEEGSWGRWVQKKFQKYIGFAPCIFHGRGLFSSDTWGLVPYSKPITTVVGEPITIPKLEHPTQQDIDLYHTMYMEALVKLFDKHKTKFGLPETEVLEVN

SEQ ID NO: 217 - protein, 328 aa, Homo sapiens
MAHSKQPSHFQSLMLLQWPLSYLAIFWILQPLFVYLLFTSLWPLPVLYFAWLFLDWKTPERGGRRSAWVRNWCVWTHIRDYFPITILKTKDLSPEHNYLMGVHPHGLLTFGAFCNFCTEATGFSKTFPGITPHLATLSWFFKIPFVREYLMAKGVCSVSQPAINYLLSHGTGNLVGIVVGGVGEALQSVPNTTTLILQKRKGFVRTALQHGAHLVPTFTFGETEVYDQVLFHKDSRMYKFQSCFRRIFGFYCCVFYGQSFCQGSTGLLPYSRPIVTVVGEPLPLPQIEKPSQEMVDKYHALYMDALHKLFDQHKTHYGCSETQKLFFL

SEQ ID NO: 218 - protein, 361 aa, Bos taurus
MKTLIAAYSGVLRGTGSSILSALQDLFSVTWLNRAKVEKQLQVISVLQWVLSFLVLGVACSVILMYTFCTDCWLIAVLYFTWLVFDWNTPKKGGRRSQWVRNWAVWRYFRDYFPIQLVKTHNLLTSRNYIFGYHPHGIMGLGAFCNFSTEATEVSKKFPGIRPYLATLAGNFRMPVLREYLMSGGICPVNRDTIDYLLSKNGSGNAIIIVVGGAAESLSSMPGKNAVTLRNRKGFVKLALRHGADLVPTYSFGENEVYKQVIFEEGSWGRWVQKKFQKYIGFAPCIFHGRGLFSSDTWGLVPYSKPITTVVGEPITIPRLERPTQQDIDLYHAMYVQALVKLFDQHKTKFGLPETEVLEVN

SEQ ID NO: 219 - protein, 388 aa, Mus musculus
MKTLIAAYSGVLRGERRAEAARSENKNKGSALSREGSGRWGTGSSILSALQDIFSVTWLNRSKVEKQLQVISVLQWVLSFLVLGVACSVILMYTFCTDCWLIAVLYFTWLAFDWNTPKKGGRRSQWVRNWAVWRYFRDYFPIQLVKTHNLLTTRNYIFGYHPHGIMGLGAFCNFSTEATEVSKKFPGIRPYLATLAGNFRMPVLREYLMSGGICPVNRDTIDYLLSKNGSGNAIIIVVGGAAESLSSMPGKNAVTLKNRKGFVKLALRHGADLVPTYSFGENEVYKQVIFEEGSWGRWVQKKFQKYIGFAPCIFHGRGLFSSDTWGLVPYSKPITTVVGEPITVPKLEHPTQKDIDLYHAMYMEALVKLFDNHKTKFGLPETEVLEVN

SEQ ID NO: 220 - protein, 3 aa, Artificial Sequence
  conserved sequence
YFP

SEQ ID NO: 221 - protein, 4 aa, Artificial Sequence
  conserved sequence
HPHG

SEQ ID NO: 222 - protein, 4 aa, Artificial Sequence
  conserved sequence
EPHS

SEQ ID NO: 223 - protein, 24 aa, Artificial Sequence
  conserved sequence
  X (2)..(2): any amino acid
  X (5)..(5): any amino acid
  X (6)..(6): Lysine (K) or Arginine (R)
  X (7)..(7): any amino acid
  X (9)..(11): any amino acid
  X (13)..(15): any amino acid
  X (16)..(16): Leucine (L) or Valine (V)
  X (19)..(21): any amino acid
  X (24)..(24): Glutamic Acid (E) or Glutamine (Q)
RXGFXXXAXXXGXXXXVPXXXFGX

SEQ ID NO: 224 - protein, 8 aa, Artificial Sequence
  conserved sequence
  X (3)..(3): any amino acid
  X (5)..(7): any amino acid
FLXLXXXN

SEQ ID NO: 225 - protein, 118 aa, Artificial Sequence
  conserved sequence
ALVVANHQSFLDPLVLSALLPRKGGRVRFVAKKELFYVPLLGWLLRLLGAIFIDRENGRLARAALREAVRLLRDGGWLLIFPEGTRSRPGKLLPFKKGAARLALEAGVPIVPVAIRGT

SEQ ID NO: 226 - protein, 187 aa, Artificial Sequence
  conserved sequence
  X (15)..(15): any amino acid
  X (18)..(18): any amino acid
  X (23)..(23): any amino acid
  X (25)..(26): any amino acid
  X (28)..(30): any amino acid
  X (32)..(33): any amino acid
  X (35)..(38): any amino acid
  X (41)..(41): any amino acid
  X (46)..(48): any amino acid
  X (53)..(53): any amino acid
  X (55)..(57): any amino acid
  X (61)..(61): any amino acid
  X (67)..(67): any amino acid
  X (72)..(72): any amino acid
  X (74)..(77): any amino acid
  X (79)..(79): any amino acid
  X (114)..(114): any amino acid
  X (127)..(128): any amino acid
  X (136)..(136): any amino acid
  X (139)..(142): any amino acid
  X (144)..(144): any amino acid
  X (150)..(150): any amino acid
  X (164)..(165): any amino acid
  X (167)..(172): any amino acid
AVFDKDGTLTEDDTXFLXYLLKXLXXLXXXLXXDXXXXGSXLTLSXXXDLLEXLXXXGGIXVIGLAXRYLEXLXXXXEXAKLFEGFIKPDAAELLKELHEAGLRVVVLTGDPRXIAKPVAKELGIDXXNVLATELXDEXXXXVXGRITGXLDKARAVERLVVLXXKXXXXXXVVAIGDSANDLPALK

SEQ ID NO: 227 - protein, 190 aa, Artificial Sequence
  conserved sequence
IKAVVFDKDGTLTDGEPPIAEAIVEAAAELGLPLLLPLEEVEKLLGRGVEGIERILLEGGLTAELLLELEGELAAGKTAVLVALDGEVLGLIALADKLYPGAREALKALKERGIKVAILTNGDRANAEAVLEALGLADLFDVIVDSDDVGPVKPKPEIFLKALERLGVKPEEVLMVGDGVNDAPALAAAG

SEQ ID NO: 228 - protein, 15 aa, Artificial Sequence
  conserved sequence
GDLVICPEGTTCREP

SEQ ID NO: 229 - protein, 6 aa, Artificial Sequence
  conserved sequence
  X (2)..(2): any amino acid
  X (4)..(4): any amino acid
  X (5)..(5): Threonine (T) or Valine (V)
  X (6)..(6): Leucine (L) or Valine (V)
DXDXXX

SEQ ID NO: 230 - protein, 8 aa, Artificial Sequence
  conserved sequence
  X (2)..(2): 17 to 20 amino acids; where the amino acids can be any amino acids
  X (3)..(3): Glycine (G) or Serine (S)
  X (4)..(4): Aspartic Acid (D) or Serine (S)
  X (5)..(7): any amino acid
  X (8)..(8): Aspartic Acid (D) or Asparagine (N)
KXXXXXXX

SEQ ID NO: 231 - DNA, 1580 bp, Arabidopsis thaliana
cagggtttatttaacttgccctttctcgtttcctcctttttttcttaaaccactctgcttcctcttcctctgagaaatcaaatcactcacactccaaaaaaaaatctaaactttctcagagtttaatgaagaagcgcttaaccacttccacttgttcttcttctccatcttcctctgtttcttcttctactactacttcctctcctattcagtcggaggctccaaggcctaaacgagccaaaagggctaagaaatcttctccttctggtgataaatctcataacccgacaagccctgcttctacccgacgcagctctatctacagaggagtcactagacatagatggactgggagattcgaggctcatctttgggacaaaagctcttggaattcgattcagaacaagaaaggcaaacaaggtttcgagcatatgacagtgaagaagcagcagcacatacgtacgatctggctgctctcaagtactggggacccgacaccatcttgaattttccggcagagacgtacacaaaggaattggaagaaatgcagagagtgacaaaggaagaatatttggcttctctccgccgccagagcagtggtttctccagaggcgtctctaaatatcgcggcgtcgctaggcatcaccacaacggaagatgggaggctcggatcggaagagtgtttgggaacaagtacttgtacctcggcacctataatacgcaggaggaagctgctgcagcatatgacatggctgcgattgagtatcgaggcgcaaacgcggttactaatttcgacattagtaattacattgaccggttaaagaagaaaggtgttttcccgttccctgtgaaccaagctaaccatcaagagggtattcttgttgaagccaaacaagaagttgaaacgagagaagcgaaggaagagcctagagaagaagtgaaacaacagtacgtggaagaaccaccgcaagaagaagaagagaaggaagaagagaaagcagagcaacaagaagcagagattgtaggatattcagaagaagcagcagtggtcaattgctgcatagactcttcaaccataatggaaatggatcgttgtggggacaacaatgagctggcttggaacttctgtatgatggatacagggttttctccgtttttgactgatcagaatctcgcgaatgagaatcccatagagtatccggagctattcaatgagttagcatttgaggacaacatcgacttcatgttcgatgatgggaagcacgagtgcttgaacttggaaaatctggattgttgcgtggtgggaagagagagcccaccctcttcttcttcaccattgtcttgcttatctactgactctgcttcatcaacaacaacaacaacaacctcggtttcttgtaactatttggtctgagagagagagctttgccttctagtttgaatttctatttcttccgcttcttcttcttttttttcttttgttgggttctgcttagggtttgtatttcagtttcagggcttgttcgttggttctgaataatcaatgtctttgccccttttctaatgctccaagttcagat

SEQ ID NO: 232 - DNA, 1584 bp, Arabidopsis thaliana
cagggtttatttaacttgccctttctcgtttcctcctttttttcttaaaccactctgcttcctcttcctctgagaaatcaaatcactcacactccaaaaaaaaatctaaactttctcagagtttaatgaagaagcgcttaaccacttccacttgttcttcttctccatcttcctctgtttcttcttctactactacttcctctcctattcagtcggaggctccaaggcctaaacgagccaaaagggctaagaaatcttctccttctggtgataaatctcataacccgacaagccctgcttctacccgacgcagctctatctacagaggagtcactagacatagatggactgggagattcgaggctcatctttgggacaaaagctcttggaattcgattcagaacaagaaaggcaaacaagtttatctgggagcatatgacagtgaagaagcagcagcacatacgtacgatctggctgctctcaagtactggggacccgacaccatcttgaattttccggcagagacgtacacaaaggaattggaagaaatgcagagagtgacaaaggaagaatatttggcttctctccgccgccagagcagtggtttctccagaggcgtctctaaatatcgcggcgtcgctaggcatcaccacaacggaagatgggaggctcggatcggaagagtgtttgggaacaagtacttgtacctcggcacctataatacgcaggaggaagctgctgcagcatatgacatggctgcgattgagtatcgaggcgcaaacgcggttactaatttcgacattagtaattacattgaccggttaaagaagaaaggtgttttcccgttccctgtgaaccaagctaaccatcaagagggtattcttgttgaagccaaacaagaagttgaaacgagagaagcgaaggaagagcctagagaagaagtgaaacaacagtacgtggaagaaccaccgcaagaagaagaagagaaggaagaagagaaagcagagcaacaagaagcagagattgtaggatattcagaagaagcagcagtggtcaattgctgcatagactcttcaaccataatggaaatggatcgttgtggggacaacaatgagctggcttggaacttctgtatgatggatacagggttttctccgtttttgactgatcagaatctcgcgaatgagaatcccatagagtatccggagctattcaatgagttagcatttgaggacaacatcgacttcatgttcgatgatgggaagcacgagtgcttgaacttggaaaatctggattgttgcgtggtgggaagagagagcccaccctcttcttcttcaccattgtcttgcttatctactgactctgcttcatcaacaacaacaacaacaacctcggtttcttgtaactatttggtctgagagagagagctttgccttctagtttgaatttctatttcttccgcttcttcttcttttttttcttttgttgggttctgcttagggtttgtatttcagtttcagggcttgttcgttggttctgaataatcaatgtctttgccccttttctaatgctccaagttcagat

SEQ ID NO: 233 - DNA, 1470 bp, Arabidopsis thaliana
cagggtttatttaacttgccctttctcgtttcctcctttttttcttaaaccactctgcttcctcttcctctgagaaatcaaatcactcacactccaaaaaaaaatctaaactttctcagagtttaatgaagaagcgcttaaccacttccacttgttcttcttctccatcttcctctgtttcttcttctactactacttcctctcctattcagtcggaggctccaaggcctaaacgagccaaaagggctaagaaatcttctccttctggtgataaatctcataacccgacaagccctgcttctacccgacgcagctctatctacagaggagtcactagacatagatggactgggagattcgaggctcatctttgggacaaaagctcttggaattcgattcagaacaagaaaggcaaacaagtttatctgggagcatatgacagtgaagaagcagcagcacatacgtacgatctggctgctctcaagtactggggacccgacaccatcttgaattttccggcagagacgtacacaaaggaattggaagaaatgcagagagtgacaaaggaagaatatttggcttctctccgccgccagagcagtggtttctccagaggcgtctctaaatatcgcggcgtcgctaggcatcaccacaacggaagatgggaggctcggatcggaagagtgtttgggaacaagtacttgtacctcggcacctataatacgcaggaggaagctgctgcagcatatgacatggctgcgattgagtatcgaggcgcaaacgcggttactaatttcgacattagtaattacattgaccggttaaagaagaaaggtgttttcccgttccctgtgaaccaagctaaccatcaagagggtattcttgttgaagccaaacaagaagttgaaacgagagaagcgaaggaagagcctagagaagaagtgaaacaacagtacgtggaagaaccaccgcaagaagaagaagagaaggaagaagagaaagcagagcaacaagaagcagagattgtaggatattcagaagaagcagcagtggtcaattgctgcatagactcttcaaccataatggaaatggatcgttgtggggacaacaatgagctggcttggaacttctgtatgatggatacagggttttctccgtttttgactgatcagaatctcgcgaatgagaatcccatagagtatccggagctattcaatgagttagcatttgaggacaacatcgacttcatgttcgatgatgggaagcacgagtgcttgaacttggaaaatctggattgttgcgtggtgggaagagagagcccaccctcttcttcttcaccattgtcttgcttatctactgactctgcttcatcaacaacaacaacaacaacctcggtttcttgtaactatttgtttcagggcttgttcgttggttctgaataatcaatgtctttgccccttttctaatgct

SEQ ID NO: 234 - DNA, 1397 bp, Arabidopsis lyrata
cagggtttatttaacttgccctttctcgtttcctcctttttttcttaaaccactcttccttcttcctctgatttcccagattttaatgaagaggcgcttaaccacttccacttcttcttcttctccatcttcctctgtttcttcttctactactacttcctctcctattcaatcggaggctcccaggcctaaacgagccaaaagggctaagaaatcgtctccttctggtgataaatcacataacccgacaagccctgcttctaccagacgcagctctatctacagaggagtcactagacatagatggactgggagattcgaggctcatctttgggacaaaagctcttggaattcgattcagaacaagaaaggcaaacaaggagcatatgacagcgaagaagcagcagcacatacgtacgatctggctgctctcaagtactggggacccgacaccatcttgaattttccggcagagacgtacacaaaggaattggaagagatgcagagagtgacaaaggaagaatatttggcttctctccgccgccagagcagtggtttctccagaggcgtctctaaatatcgcggcgtcgctaggcatcaccataacggaagatgggaggctcggattggaagagtgtttgggaacaagtacttgtacctcggcacctataatacgcaggaggaagctgctgcggcgtatgatatggcggcgatagagtatcgaggtgcgaacgcggttactaattttgacattagtaattacatcgaccggttaaagaagaaaggtgttttcccgttccctgtgaaccaacctaatcatcaagaggctattcttgttgaagccaaacaagaaatcgaaacgagagaagctaaagaagagcctagagaagaagtgaaacaacagtacgtggaagaaccaccacaagaagagaaagaagaagagaaagcagagcaacaagaagcagagtttgtaggatataaagatgaaggggcggtggtcaattgctgcatagactcttcagccataatggaaatgaatcgttgtggggacaacaatgagctggcttggaacttctgtatgatggattcagggtttgctccgtttttgacggatcagaatctctcaaatgagaatcccatcgagtatccggagcttttcaatgagttagcatttgaggataacattgacttcatgttcgacgaagccaagaacgactgcctgagcttggaaaatctggattgttgcgtggtgggaagagagagcccaacttcttcgtcttcaccattgtcttgcttttctactgactctgcttcatcaacaacaacaacaacctcggtttcttgtaactatttgggcttgttcgttggttctgaataatcaatgtctttgccccttt

SEQ ID NO: 235 - DNA, 1242 bp, Brassica napus
atgaagagacccttaaccacttctccttcttcctcctcttctacttcttcttcggcctgtatacttccgactcaatcagagactccaaggcccaaacgagccaaaagggctaagaaatcttctctgcgttctgatgttaaaccacagaatcccaccagtcctgcctccaccagacgcagctctatctacagaggagtcactagacatagatggacagggagatacgaagctcatctatgggacaaaagctcgtggaattcgattcagaacaagaaaggcaaacaagtttatctgggagcatatgacagcgaggaagcagcagcacatacgtacgatctagctgctctcaagtactggggtcccaacaccatcttgaactttccggttgagacgtacacaaaggagctggaggagatgcagagatgtacaaaggaagagtatttggcttctctccgccgccagagcagtggtttctctagaggcgtctctaaatatcgcggcgtcgccaggcatcaccataatggaagatgggaagctcggattggaagggtgtttggaaacaagtacttgtacctcggcacctataatacgcaggaggaagctgcagctgcatatgacatggcggctatagagtacagaggtgcaaacgcagtgaccaacttcgacattggtaactacatcgaccggttaaagaaaaaaggtgtcttcccgttccccgtgagccaagctaatcatcaagaagctgttcttgctgaaaccaaacaagaagtggaagctaaagaagagcctacagaagaagtgaagcagtgtgtcgaaaaagaagaagctaaagaagagaagactgagaaaaaacaacaacaagaagtggaggaggcggtgatcacttgctgcattgattcttcagagagcaatgagctggcttgggacttctgtatgatggattcagggtttgctccgtttttgactgattcaaatctctcgagtgagaatcccattgagtatcctgagcttttcaatgagatgggttttgaggataacattgacttcatgttcgaggaagggaagcaagactgcttgagcttggagaatcttgattgttgcgatggtgttgttgtggtgggaagagagagcccaacttcattgtcgtcttctccgttgtcctgcttgtctactgactctgcttcatcaacaacaacaacagcaacaacagtaacctctgtttcttggaactattctgtctga

SEQ ID NO: 236 - DNA, 1248 bp, Brassica napus
atgaagagacccttaaccacttctccttctacctcctcttctacttcttcttcggcttgtatacttccgactcaaccagagactccaaggcccaaacgagccaaaagggctaagaaatcttctattcctactgatgttaaaccacagaatcccaccagtcctgcctccaccagacgcagctctatctacagaggagtcactagacatagatggacagggagatacgaggctcatctatgggacaaaagctcgtggaattcgattcagaacaagaaaggcaaacaagtttatctgggagcatatgacagcgaggaagcagcagcgcatacgtacgatctagctgctctcaagtactggggtcccgacaccatcttgaactttccggctgagacgtacacaaaggagttggaggagatgcagagatgtacaaaggaagagtatttggcttctctccgccgccagagcagtggtttctctagaggcgtctctaaatatcgcggcgtcgccaggcatcaccataacggaagatgggaagctaggattggaagggtgtttggaaacaagtacttgtacctcggcacttataatacgcaggaggaagctgcagctgcatatgacatggcggctatagagtacagaggcgcaaacgcagtgaccaacttcgacattagtaactacatcgaccggttaaagaaaaaaggtgtcttcccattccctgtgagccaagccaatcatcaagaagctgttcttgctgaagccaaacaagaagtggaagctaaagaagagcctacagaagaagtgaagcagtgtgtcgaaaaagaagaaccgcaagaagctaaagaagagaagactgagaaaaaacaacaacaacaagaagtggaggaggcggtggtcacttgctgcattgattcttcggagagcaatgagctggcttgggacttctgtatgatggattcagggtttgctccgtttttgacggattcaaatctctcgagtgagaatcccattgagtatcctgagcttttcaatgagatggggtttgaggataacattgacttcatgttcgaggaagggaagcaagactgcttgagcttggagaatctggattgttgcgatggtgttgttgtggtgggaagagagagcccaacttcattgtcgtcttcaccgttgtcttgcttgtctactgactctgcttcatcaacaacaacaacaacaataacctctgtttcttgtaactattctgtctga

SEQ ID NO: 237 - DNA, 868 bp, Glycine max
gaggctccaaatgaagaggtctccagcatcttcttgttcatcatccacttcctctgttgggtttgaagttcatcatcccattgaaaaaagaaggcctaagcatccaaggaggaataatttgaagtcacaaaaatgcaagcagaaccaaaccaccactggtggcagaagaagctctatctatagaggagttacaaggcataggtggacagggaggtttgaagctcacctatgggataagagctcttggaacaacattcagagcaagaagggtaaacaagtttatttgggggcatatgatactgaagaatctgcagcacgtacctatgaccttgcagcccttaagtactggggaaaagatgccaccctgaatttcccgatagaaacttataccaaggacctcgaggaaatggacaaggtttcaagagaagaatatttagcttctttgcggcgccaaagcagtggcttttctagaggcatctctaagtaccgtggggttgctaggcatcatcataatggtcgctgggaagctcgcattggaagagtatgtggaaacaagtacctctacttgggaacatataaaactcaagaggaggcagcagtggcatatgacatggcagcaattgagtaccgtggagtcaatgcagtgaccaattttgacataagcaactacatggacaaaataaagaagaaaaatgaccaaaccctacaacaacaacaaacagaagtacaaacagaaacagttcctaactcctctgactctgaagaagcagaagtagaacaacaacacacaacaacaataactacaccacccccatctgaaaatctgcacatgctaccacaggaacaccaagtaggtggatgggtgtga

SEQ ID NO: 238 - DNA, 1254 bp, Jatropha curcas
atgaagaggtcttctgcttcatcttgctcttcttcttcttcttcttcttcttctccatcctcttcttcgtcttctgcttgttctgcttcgtcttcttgcttagattcagtatctcctcctaatcaccatcaattacgatcagagaaatcaaaatccaaacgcattcgaaaaattcaaaccaagcaagataaatgtcagactacagctactaccaccagtccaagcggcggcggtaggagaagctccatttacagaggagtcacccggcatagatggactggaaggtttgaagctcatctttgggataagagttcttggaataacattcaaaacaagaaaggaaggcaagtttatttgggggcttacgacaatgaggaagcagctgctcatacctatgatcttgctgctctcaagtactggggacaagacaccactttgaattttccgatagaaacatactcaaaggagcttgaagagatgcaaaagatgagcaaggaagagtacttagcatctcttcgacggagaagcagtggattttcaagaggagtttctaagtaccggggagtagctaggcatcatcacaatggccggtgggaagctcgaattggccgggtttttggcaataagtatctctacctcggaacttacaatacacaagaagaggcagcagcagcatatgatatggcagcaatagagtacagaggagcaaatgcagtaaccaattttgatgtcagccattacatagaccgtttgaagaagaaaggcattcctttagataaaatcctaccagaaacactttctaaaggctcaaaagagtcagaagaaatcgagcgaacctcacccttaccgttgccatcaccaccatcaccatcaataacaccattacacgaagaaatagtctcaccacagctgcttgaaactgaatgcccacaacatcctccatgtatggatacttgtactatgatcgttatggaccctatagaagagcacgagcttacttggagcttctgtctcgattcggggttagttccgctccctgtgcctgacctaccactagcaaatggctgtgagttaccagacttgttggatgacacaggctttgaagacaatattgacttgatatttgatgcttgttgcttcggaaatgatgccaaccctgcagatgagaatgggaaagagaggttgtcttccgcttcaacttctccatcttgttccacaacattaacttctgtttcttgtaactattctgtttga

SEQ ID NO: 239 - DNA, 1332 bp, Ricinus communis
atgaagaggtctcctacttccccgtgctcttcttcttcatcatcttcatattcatcttcttcagcttcatcttcttgtgtcggtcctgatgatactcctgtcgctcctggtagtcatcatcatcatgatcaccaccaattacgatcgcagaaatcatccaaacgcattagaaaagttaaaaaaaagcagcagaaccataatattgatcagaataatactaacaccactattactgctcctacctctgccagaagaagctccatttacagaggagtcacccggcatagatggacgggaaggtttgaggcacacctttgggataagagttcatggaataacattcaaaacaagaagggaagacaaggggcctatgataatgaagaagcagctgctcatacttatgaccttgctgcccttaagtactggggaccagagacaaccttgaatttccccatagaaacatatcctaaagagcttgaagagatgcaaaagatgagcaaggaagagtacttggcatctcttcgacgccaaagcagtgggttttccagaggagtttctaagtaccgtggggttgctaggcatcaccacaatggtcgatgggaggcacgaatcggacgagtttttggcaacaagtatctctaccttggcacttataacacacaagaggaggcagcagcagcatatgatatggcagcaattgagtacagaggagcaaatgctgtgaccaattttgatatcagcaattacatagaccgcttgaagaagaaaggcatccttttagaccagatactccctgatcaaccacttagaaaatgctctagcgaatctgaagaagcagaagcagaagcagaagttgaacgactgccgtcactgccctcatcgatattaccacaagaacaggacacaatctcaccacaacttcaatgcacacagctccttccatccatggactcttgcacaatgattaatatggaccctatcgaagataatgagctcacctggagtttttgcttggattctgggctgacccttttctcagtacccgagctccccctcgaaaatgcttgcgagctaccggacttgttcgatgacacaggctttgaagacaatatagacttgatatttgatgggtgttgctttggaaatgatgatgacggtggtggtggtgccaaccaccaggaatttatggtggaaagtagaggatgtagggtaggggaggttgggatttcagggagcatggaggaggaaaacgggaaggagatgtgttgcagttcaagttcgccatcttgttcaacaaccacctcggtttcttgttgtaactattctgtttga

SEQ ID NO: 240 - DNA, 1209 bp, Populus trichocarpa
atgaagaggtcttcatcttgctcctcctcctcctcctcctcatcttcttcttgtgttgcctctgaaagcattcacaaaccaaaggccaaacgcattagaaagaatcaaaagagcaatcaaggcaaatcccagaatgctgctgctgctgctgctaataacagtcataactcaggcaaaagaagttccatttatagaggagtcaccagacatagatggacaggaaggtttgaagctcatctttgggataagagttcatggaacagcattcaaaacaagaagggaaaacaaggtgcctatgacaatgaggaggcagccgcacacacctatgatcttgctgccctgaagtactgggggtcagagacaaccttgaattttccgatagaaacatacactaaagagatcgaagagatgcaaaaggtgactaaagaagagtacttagcatctcttagacggcaaagcagtggattctctagaggagtctccaaataccgtggggtggctaggcatcatcataatggccgatgggaagctagaattggacgagtttatgggaataagtatctctaccttggaacttacaatacacaagaagaggcagcggcagcgtatgatatggcggcgatacagtatagaggagcaaatgcagtgaccaattttgatgttagcaattacatagaacggttgaggaagaaaggcatccctatagaccgaatcctccaagaacaacaacttcttaacaactcggtagattccagcgtggaagtggaagttgaacaaccaacaccaccaccacaacaacaacaagaggaacaagaacaaaagatagtctcgtcgtcttcgcaacttcaatgttcacagctaaattcaagcttggatggcacgcctcctatggtaattatggacactattgaagagcacgagctagcatggagcttttgtatggattcaggattgagcctcacaatgcctgatcttcctctcgaaaattcctgcgagttaccggacttgttcgatcatacagggtttgaggacaacattgacttgatattcgatgcatgttgctatggaaaggaggccaatccggctggctacacattagaagataatagcacaggaggagttgaagaggacaggttgtcgtctgattctgtctcaaattctccaactagttcaacaaccacctctgtttcttgtaactattctgtttga

SEQ ID NO: 241 - DNA, 1546 bp, Brachypodium distachyon
atgaagagatcccctcctcagccgtccccgtctccttcctcttcgccggcctcctcgtcgtcgtccccgtcctcctccgactcgtcttcctcgatcgccattccccgcaagagagcgaggacggcggcggcggcggcgggcggcggcaaggccagggcggcggccgccaagaggcccaagaaagatggcaaggactccggctcctcctccaatggcggcggcggcggcggcgggaagaggagctccatctacaggggagtcacgaggcacaggtggacaggtagatttgaggcgcatctctgggacaagaactgcttcacttcgcttcagaacaagaagaaaggcaggcaagtctatctgggggcttatgatacagaggaggcagctgctcgtgcatatgaccttgcagctctcaaatactggggtcctgaaacaacactaaatttctcagcggatgattatgggaaggagaggtcggagatggaggcggtgtcgcgggaggagtacctcgccgcccttcgccgccggagcagcggcttctcaaggggtgtctccaagtaccgcggggtcgccaggcatcaccataacgggcggtgggaggcgcgaatagggcgggtgctggggaacaagtacctttacctgggcacctttgatactcaagaggaggcagccagggcctatgatcttgcagccatccaataccgaggtgccaatgcagtaacgaacttcgacattagccgctacctggaccagccacagttactggaacaactgcagcagcagcaggggccacaggtggtggcagcattgcaagaggaagctcaacgtgatcaccaaagtgacaatgcagtccaagagctcaattcaggggaagcgcagacacctggtggcatcgatgagccgattgcaataggcgacagtactgaagacatcaacacctcccttacggttgatgacatcattgaagagagcctctggagtccttatgaatttgatatcatggctggagtgaacgtcagcaactcgatgaatctgagcgagttgttcagcgatgttgcctttgagggcaacattgggtgcctgtttgaagaatgctccggcatcgatgactgcagcagcaggcatggtgcaggtttggcagcatttggtttgtttacggaaggcgacgataagctgaaggatgtttcagagatggagatggaagtaaatcctcaagcaaatgatgtctcctgccctccaaaaatgatcactgtgtgcaattgagcatccttgtgcgtgcgtgagcatctttgtgttctgatgtccaaggaggtttttagctgtccatgttgggtatatttcttagaatagcttcttgtaggctgtctgatcaggtgggagagattcatgtgctcctccctatcctttgtgaaaaccccgaaggctgctgccaattgccatgatagtgcagtgtttcctttctttttcccccaattagcacaaggctaatatactaacctcaaaagatgtcctcacttaacctagattcaacaaattatattgtggt

SEQ ID NO: 242 - DNA, 1500 bp, Hordeum vulgare
ggcctccccactcttcctcggcccaccaccattgacacagagatcatgaagagatcccctcctccccagccatctccttcttcttcgccggcatgctcgccctcgccgtcttctccttcctcgtccgactcgtcttcgatagccattccccgcaagcgagcgcggacgcagaaggccgggagcgccaaggcgaaggccgcgcccaagcgggccaagaaagactcgggcaggagcaccaaggactctgacgcctccgccaatggcgccgccgcgtctgggaagagaagctccatctacaggggggtcacaaggcacaggtggacaggcagatttgaggcacacctctgggacaagaattgcttcacttccatccagaacaagaagaaagggaggcaagtctatctgggggcttatgacacagaggaggcagctgctcgtgcgtatgaccttgcagctctcaaatattgggggcctgaaaccacactgaatttcacggtggatgagtacgcgaaggagaggtcagagatggaggcggtgtcgcgggaggagtacctcgccgcgctccgccgccggagcagcggcttctccaggggggtctccaagtacaggggcgtcgccaggcaccaccacaatgggcgatgggaggcgcgaatcggaagggtgctggggaacaagtacctgtacctgggaacctttgatacccaagaggaagcagccagggcctatgatcttgctgccatcgaataccggggcgcaaatgccgtaaccaattttgacattagccgctacctggaccagccgcagttactggcgcaactggagcaggggccacaggtggtgccagcattgcaagaggagcttcaacatgatcaccaaagtgacaatgcagtacaagagctcaactctggtgaagcgcagaagccaggtagcgtcagcgagccgattgcagtggatgacacagacaatacaggagacatcggtgccccccttgtgtttgacagcggcgtcgaggagaacctgtggagcccttgcatggattatgatgtggaccccatctttggacccaacatcagcagctcgatgaatctgagcgagtggttcaacgatcccgccttcgagagcaacatcgggtacatgttcgaaggatgttcggacgtcgatgactgcagcaccaggcatggcgcaggtctgtcagcgttgggttttctcaaggaaggcgacgataagctgaaggatggttcagacatggaggcagaaataactcctcaggcaaacgatgtctcctgccctccaaaaatgatcaccgtgtgtaattgagcatctctgtgctctcatgtccaaggaaggtttcaggttttcatgttggttatacctcttagctagcttcttgtaggctgtctgtctgtctgatcaggtcagagaaattcatgtgttcattcccatcctttgagaaaaaacccaaaggcattcaacttggtatggcaagaatgccaatgctcc

SEQ ID NO: 243 - DNA, 1669 bp, Sorghum bicolor
ctcagattcaccgccgcgcgcgtctcctccccctgcaccaccaccagtacaccgttcatcgaggagagggacgggacgggacggagaccaccatggacatggagagatctcagcagcagaagtctccgacggagtctccgccgccgccgtcgccgtcgtcctcctcgtcctctgtctccgcggacaccgtcctgccccctcccgggaagaggcggagggcggcaacgacggccaaggccaaggccggcgccaagcctaagagggcccgtaaggacgccgccgccgcggctgatcctcctcctcctcccgccgccgccgccgccgggaagaggagctccgtctacaggggagtcaccaggcacaggtggacggggaggttcgaggcgcatctctgggacaagcactgcctcgccgcgctccacaacaagaagaaaggcaggcaagtctatctgggggcgtatgacagcgaggaggcagctgctcgtgcctatgaccttgcagctctcaagtactggggtcctgagaccctgctcaacttccctgtggaggattactccagcgagatgccggagatggagggcgtgtcccgggaggagtacctggcctccctccgccgcaggagcagcggcttctccaggggcgtctccaagtacagaggcgtcgccaggcatcaccacaacgggaggtgggaggcacggattgggcgagtctttgggaacaagtacctctacttgggaacatttgacactcaagaagaggcagccaaggcctatgatcttgcggccattgaataccgaggtgtcaatgctgtaaccaacttcgacattagctgctacctggaccacccactgttcctggcgcagctccaacaggaaccacaggtggtgccagcactcaaccaagaagctcaacctgatcagagcgaaacagaaactatagcccaagagtctgtgtcaagcgaagcgaagacaccagatgacaatgcagaacctgatgacaatgcagagcctgatgacatcgcggagcccctcatcacagtcgacgacagcatcgaagagagcttatggagcccttgcatggattatgagctagacaccatgtcaaggtctaactttggcagctcgattaatctgagcgagtggttcaatgatgcagacttcgacagcaacattggatgcctgttcgatgggtgttctgcggttgatgaaggcggcaaggatggtgtaggcctggcagatttcagtctgttggaagatttcagtctgtttgaagcaggtgatggtcagctgaaggatgttctttcagatatggaagagggaatccaacctccaacaatgatcagtgtgtgcaattgattctgaaacctatgcgtcgcgtgcgtgcctatgtgagatatccaaggaggttttcactttttaggtgtcctgtcttgggtatacttgatttgtccaatgccacagagccactgctgcaaaagcagctgaactttcttgtagaaagcccatggcagcttggcattagacaagtgtgttgatgttccttaattctttgaatttgttcgaggctgcttgactaaccttaagggtttgtcattgtcgcgcttagcctagattcaactaatcacatcctgaatctgaagtaattgtgcagtatcacaattttacatggc

SEQ ID NO: 244 - DNA, 1576 bp, Zea mays
ctcccccgcctcgccgccagtcagattcaccaccggctcccctgcacaaccgcgtccgcgctgcaccaccaccgttcatcgaggaggaggggggacggagaccacggacatggagagatctcaacggcagtctcctccgccaccgtcgccgtcctcctcctcgtcctccgtctccgcggacaccgtcctcgtccctcccggaaagaggcggagggcggcgacggccaaggccggcgccgagcctaataagaggatccgcaaggaccccgccgccgccgccgcggggaagaggagctccgtctacaggggagtcaccaggcacaggtggacgggcaggttcgaggcgcatctctgggacaagcactgcctcgccgcgctccacaacaagaagaaaggcaggcaagtctacctgggggcgtatgacagcgaggaggcagctgctcgtgcctatgacctcgcagctctcaagtactggggtcctgagactctgctcaacttccctgtggaggattactccagcgagatgccggagatggaggccgtttcccgggaggagtacctggcctccctccgccgcaggagcagcggcttctccaggggcgtctccaagtacagaggcgtcgccaggcatcaccacaacgggaggtgggaggcacggattgggcgagtctttgggaacaagtacctctacttgggaacatttgacactcaagaagaggcagccaaggcctatgaccttgcggccattgaataccgtggcgtcaatgctgtaaccaacttcgacatcagctgctacctggaccacccgctgttcctggcacagctccaacaggagccacaggtggtgccggcactcaaccaagaacctcaacctgatcagagcgaaaccggaactacagagcaagagccggagtcaagcgaagccaagacaccggatggcagtgcagaacccgatgagaacgcggtgcctgacgacaccgcggagcccctcagcacagtcgacgacagcatcgaagagggcttgtggagcccttgcatggattacgagctagacaccatgtcgagaccaaactttggcagctcaatcaatctgagcgagtggttcgctgacgcagacttcgactgcaacatcgggtgcctgttcgatgggtgttctgcggctgacgaaggaagcaaggatggtgtaggtctggcagatttcagtctgtttgaggcaggtgatgtccagctgaaggatgttctttcggatatggaagaggggatacaacctccagcgatgatcagtgtgtgcaactaattctggaacccgaggaggttttcgctttccaggtgtcctgtcttgggtaatccttgatctgtctaatgccacagtgccactgcaccagagcagctgagaactttcttgtagaaagcccatggcagtttggcgttagacaagtgtgtcgatgttctttaattctttgaatttgcccctaggctgcttggctaacgttaagggtttgtcattgtctcacttagcctagattcaactaatcacatcctgaatctgaaaaaaaaaaacaaaaaaaaaaaaaaa

SEQ ID NO: 245 - DNA, 1242 bp, Brachypodium distachyon
atggaggcctactgctccaccttggtgaaagacgagctcatcaatggcggcggcggggggtcagcaggagggatgcggtactgcgaggcggcgccgcgcgtctcgccgccggtggcgatcaagagcgtgaagagacggaagagggagccgccggcggtgtcggggatgacgacggtgagcggcggcgggaaggacggcgacaagtcggcgggcaatgcggcggccaagaggagctccaggttcaggggcgtcagcaggcatcgttggactggcaggttcgaggcgcacctgtgggacaaaggcacgtggaacccgacgcagaagaagaaaggaaagcaagtttatcttggggcgtacaacgaggaagaagcggcggcgagagcgtacgacctggcggcgctcaagtactggggacctaccacctacaccaacttcccggtggtggactacgagaaagagctgaaggtgatgcagggcgtgtcgagggaagaatacctagcctccataagaaggaagagcaacgggttctcgcgtggcgtgtccaagtatcgtggcgtggcgcggcaccaccacaacgggcggtgggaggcccggatcgggcgtgtcttcgggaacaagtacctgtacctaggcacctacagcacccaggaggaggccgcccgcgcctacgacatcgccgccattgagtaccggggcatcaacgctgtcaccaacttcgacctcagctcctacatccgatggctcaagcccaactccaccatcaacaccaacacccccgccgccgaattagccatcctcggcggcggcggcacgcccgcggcactgatcacgccgccgccgacgatgcacgttccccgcctgctaccgccgctcgtaaagggaaggggtagctcgatcgccgacgatgtgtctgccgggtcctgcgtgttcggcggcccgtcgccgtcaccgtcaccaaccacgacggcgctcagtttgctgttgcggtcatccgtgttccaggagttggtcgcgcagcagcagcctccgtcgaccgtggatgacgatgatgacatcggtggtcacgcggcggtgtccgacgcggcccaaagagcagcggaggagaacgaggagtcattcggcgaggtgttgtacggtgccggcgagggggaggcggcaacggcattctcgtgctccatgtacgagctgggcctggacgacaatttcgcgcgcatcgaggagtccctctggggctgcttgtga

SEQ ID NO: 246 - DNA, 1467 bp, Sorghum bicolor
atggaaacctacagcctgcaggtgaaggatgagctccacggcggcggcatcggcatcggaggaggagggcaggggctgtactgcggcgctacgccgaggccggcggctcctgcggccaccggcggcggcggcggcggcggggacggtgctgtgaagagtaataagaggagtaggaagagggagccgccgccgccgccgccgtcgtccctggtgacgatgagcaacggcggcaaggacgaggcggtcgccggcagcggcgacaagtcggcgagtagcaacagtaacgcgtccaagaggagctcaaggttcagaggcgtaagcaggcatcggtggacgggcaggttcgaggcgcacctgtgggacaaagggacatggaacccaacgcagaagaagaaagggaagcaagtttaccttggagcgtacaacgaggaagacgcggcagcaagagcgtatgatctggcagcgctcaagtactggggacctaccacctacaccaactttccggtcgtggactacgagagagagctcaaagtgatgcagaatgtgtccaaggaagagtaccttgcctccatacgaaggaagagcaacggcttctcccgcggagtttccaagtacaggggcgtcgcacggcaccaccacaacggcagatgggaggcacggatcggccgggtgttcggcaacaagtacctgtacctgggcacgtacagcacgcaggaggaggcggcgcgcgcctacgacatcgccgccatcgagtaccgcggcatcaacgccgtcaccaacttcgacctcagcacctacatccgctggctcaagcccggcggcggcgtcgaggacagcgccgccggcaccccgacgtcgggcgtcagggcgccgggtataccgccggcgtcgctgtccctacaggctggcggcctcctgcagcacccgcacggcgccgcggccggcatgctgcaggtcgacgtcgacgacctctaccgcgggcagctggccgcggcgcgtggggctgctctgttctctggcggcatcgacgacgtgggctccgtgtacgcagctggcagcgcagggcccagcccgacggctctgtgcgccgggaggccgtctccatcgccgtcgccgtcgtcgtccaccacggcgctcagcctgctgctgcgctcgtcagtgtttcaggagctcgtggcgcggaacgccggcggcggcgccgcgcagcagcagcagctcgtggtcgcggacgacgacggggcagtatcgccggcggacgttgttgacgccaaagttgagcagccggaggcagagggcgagctgggtcgtcacggtgaccagctctacggcgcggcgagggcggacgaggacgaggacgcgttcgcctgctccatgtacgagcttgacgacagcttcgcgcgcatggagcagtcgctctggggctgcctacgatcatcggatgcacctgataatatgaacaacctctga

SEQ ID NO: 247 - DNA, 1332 bp, Sorghum bicolor
atggagagcagtggaatgatgatggtgaagagcgagatcgagagctgcggctacccggggccgtcgtcgtcgacggcacctgcggcaggcgtggtcatcggcggcagcgcgacgacggaacgcggcgagggggggcaccatcatcatcatcatcaggtggtggtgaggaggaggaggagggagccgcctctgctcgcaccaatcgccggcggcggcattggcaagccgctgcccagcatcaccgtcaagaggagctccaggttccgtggagtcagcaggcatcgatggacaggtcgttttgaggcacatctgtgggacaagaactcgtggaatccgacgcagcggaagaagggcaaacaggtctatctgggagcttacgatgaggaggaggctgctgccagagcctacgaccttgctgctctcaagtactgggggcccaccacctacacgaacttcccggtcatggactacgagaaggagctcaagataatggagaacctcacaaaggaagagtaccttgcatcactgaggaggaagagcagtggtttttcaagaggagtgtccaagtacagaggcgttgccagacatcatcagaacgggaggtgggaggcaagaattgggcgcgtttttgggaacaagtacctttacctaggaacttacagcactcaagaagaagccgcccgcgcatacgacatcgcggcgatagagtacaaaggcgtgaacgcggtgaccaacttcgacctgaggtcctacatcacatggctgaaacccagcggtgctccggccgccttcaacccggaggcggcgctcctgatgcaggcagctccggccgagcagctcctccacccggcagagacggcccagatgctcccacgagtcggcaacccgttcctgctggaccacggcgccgcgccgccgggcagtagcggcggcggcgggcaggacgcctccatgtcgtccatggtgtctcccggtgccggcggcggcatgaggaggagaggctcctccaccgcgctcagcctgctgctcaagtcgtccatgttcaggcagctggtcgagaagaactccgacgccgaggagggcgtcagggacagggaagatgccgccgccgccgccgctgctgcgcatccagctggaccaggagacgcctatgagtaccacaacttcttccagggagaagcgcctccggacatgtgcgatctcttctcgtcaggcggcggtggcgaccacgcgcggaatgctgggttccatggagagatcgccgcgtgctacgatgatggcgaggggttggatggctggaatgggtttggcaacatgtcatctctgcaatag

SEQ ID NO: 248 - DNA, 1271 bp, Glycine max
aggtaaattacattgttgtctgctgaaataaaaaacagaagagtgaaatggagcttgcacctgtgaagtctgaactaagtccaaggagccataggttgctcatgatagatggtagtgaggttattggcactaagtgtgtcaaaaggcggcgaagagattcatctacggccgtgttaggtggcaatggacaacaaggtgaacagttagaagaacagaagcaacttggtggccaatcaactgccaccactgtgaagagaagctcaaggttcaggggtgttagcagacacaggtggactggaaggtttgaagcacatctatgggataaagggacctggaatcccactcagaagaagaaaggaaagcaagtatatttgggagcttataatgatgaagaagctgcagctagagcttatgatttggctgcactcaagtactggggaatatcaactttcacaaattttcctgtatctgattatgagaaagaaattgagataatgaaaactgtaaccaaagaagaatatcttgcttcattgagaaggaggagcagtggtttttccagaggtgtatcgaagtatagaggagtagcaaggcatcatcacaatggaagatgggaagcaaggattgggagagtgttcggtaacaagtacctctaccttgggacttacagtacacaagaagaagcagctcgcgcatatgacattgcagcaattgaatacagaggcataaatgcagtgacaaactttgacttgagcacctacataagatggctaagaccgggaacacatcctactgcttctcatgatcaaaagcctagcactgatgctcaaccttttgcaacctctaactccatgcaagcaagagggaacattgaggtatccaactccaacaagaattcattcccctcaggtaaattggacagtaccaagaagcgagacttttccaagtacatgaaccctttgagtccatgcaacaagccatcttccccaacagcattaggacttctcctaaaatcctcagtgtttagagaactgatgcagagaaatctgaactcttctagtgaagaagctgaagaagttgaattgaaatatccacatgagggcaatgatggagttggagggatttatgataatgaaaacaccaataactcttacttttgctcttctaatatcagcagattacctaacttggagtcatcagaagagagtccattgcctatgtatcatggaactgtgcaatcactatggaatagtgctttcaacatgtctaactga

SEQ ID NO: 249 - DNA, 1266 bp, Glycine max
caggtaaattacattgttgtctgctgagaaaaacagaagagtgaaatggagcttgcacctgtgaagtctgaactaagtccaaggagccataggttggtcattatagatggtagtgatgttattagcactaagtgtgccaaaaggcggcgaagagattcgtctatggccgtgttaggtggcaatggacaacaaggtgaacagttagaagaacagaagcaacttggtggccaatcaactgccaccactgtgaagagaagctcaaggttcaggggagttagcagacacaggtggactggaaggtttgaagcacatctatgggataaagggacctggaatcccactcagaagaagaaaggaaagcaagtatatttgggagcttataatgatgaagaagctgctgctagagcttatgatttggctgcactcaagtactggggaacatcaactttcacaaatttccctgtatctgattatgagaaagaaattgagataatgaaaactgtaaccaaagaagaataccttgcttcattgaggaggaggagcagcggtttttctagaggtgtatcaaagtatagaggagtagcaaggcatcatcacaatggaagatgggaagcaaggattgggagagtgttcggcaacaagtacctctaccttgggacttacagtacacaagaagaagcagcccgtgcatatgacattgcagcaattgaatacagaggcataaatgcagtgacaaattttgacttgagcacctacatcagatggctaagaccaggaacacatcctactgcttctcatgatcaaaagcctagcactgatgctcaactttttgcaacctctaactccatgcaaacaagagggaacattgaggtatccaactccaacatgcattcattcccctcaggtgaattggacagtaccaagaagcgagacttttccaagtacatgaaccctttgagtccttgcaacaagccatcttccccaacagcattaggacttctcctaaaatcctcggtgtttagagaactgatgcagagaaatctgaactcttctagtgaagaagctgatgttgaattgaaatatccacaagagggcaatgatggggttggagggatttatgataatgacaacaccagtaactcttacttttgctcttctaatatcagcagattacctaacttggagtcatcagaagagtgtccattgcctatgtatcatggaactatgcaatcactatggaatagtgctttcaacatgtctaactga

SEQ ID NO: 250 - DNA, 1257 bp, Populus trichocarpa
atggagatgacaaggaatactggcgatcagataagcctaggaaggcgtcgcttgtgcatgatagaagaagaaaggagagccggggaggctggtaagtgtattaaaagacgacgaagagacccttccacatttgcattaagctgcaatattaatgatcaacaaagtgaccagcagcagcagcaacagtcacttggtgatcgaactgcagctgttgccactactgtcaagagaagttcaagatttcggggagttagcaggcaccgttggaccggacgatttgaagctcatttatgggataaaggaacttggaatccaacacagagaaagaagggtaaacaaggagcttatgatgaagaagaatccgctgcaagagcatatgatttagctgctctcaagtactggggaacgtcaactttcacaaattttccggcgtctgactacgagaaagagattgaaataatgaaaacggtaaccaaagaagaatatctagcctccttgagaaggagaagcagtgggttttcaagaggtgtatccaaatacagaggagttgctaggcaccatcacaatgggagatgggaagcaaggatagggagagtgtttggaaacaaatatctttatcttggcacgtacagcactcaagaggaagctgctcatgcctatgatatagcagccattgaatacagagggatcaatgctgtaaccaatttcgatttaagcacatacatcagatggctgaagccagaagccagtcttcctgcacctcaaactcaagaatcgaagccagcttcagaccccctgccgatggcaaccttctccaatcaccttccgagcgagaaaccaacccagctatccgttctccagatggacccttctttaatggataatttaaacacccctaaaaacgaggacatttttcacaggaagacgcttcccgttagccccctcactaggtcatcctcctcgactgcccttagcctcctctttaaatcttcaatattcaaagagcttgtggagaagaacttgaataccacctccgaagaaattgaagaaaatgattcgaaaaacccgcataatggcaacaacaatgctggggaggcattctatgatggactcagccccattcctcacacaggcacttcaaccgaggatccgttcttgtgttcagagcaaggagagacaaatacattgccaccatacagtggaatggagcaatctctttggaatggagccttgagcatgccttctcgtttccattaa

SEQ ID NO: 251 - DNA, 1011 bp, Vitis vinifera
atggagatgactacagtgaaatctgaattaggcctggaaaggggccgcttgtgcactgcagaaactgatgctttggaggtgaccaagtgtgttaagagaaggagaagagatccatcagcagttacacccggatgcagtaaacaaggagagcagcagaagcaggtgttgctgcaggctgggcaatccattactgccattgccactactatgaagagaagttcaagattcaggggtgttagcagacatagatggacagggaggtttgaggctcatttatgggataaagggtcctggaatgtgacacagagaaaaaagggaaagcaagtctatcttggagcttatgatgaagaagaatctgctgcaagagcgtatgacttggccgcactgaagtattgggggccatcaacttttaccaatttcccagtatcagattatgagaaggagattgaaataatgcagggtctaacaaaggaggaatacttggcttctttaagaaggagaagcagtggtttttcaagaggagtgtccaagtacagaggagttgcaaggcatcatcacaacggaagatgggaagcaaggattgggagggtgtttggaaacaagtatctctaccttggaacttacagtacccaagaagaggctgctcatgcttatgacattgcagcaattgagtacagagggatcaatgctgtaacaaacttcgagttgagcacatacgtaaggtggctgaggcccagagccactgctcttacccctcaggaaccaagatcaaattcaataatgcaagcatcctctaactgccttccaaatgaggaagtagagctgtccttcctcagccccaatccttttacagtagatgacttggcaactcctctaaagcaagaaaagttccaaagagaggtttccatcagcccttgcaccaagtcatcttcgccaactgcactaagtctcctccatagatcttcagtatttagacaactggtggagaagaattcgaacagcatcgaataa

SEQ ID NO: 252 - DNA, 1170 bp, Glycine max
atggcaatgatgaaagagaatattattgaagtgagccttggaaggaggcaaatgtctatgacagaaggtgagttccaaggaacacggagcgtcaagagacgacgaagagaggttgctgcagccgcaggcagtggtgatgataaccaccaacagcagttaccacaacaagaagttggtgaaaatactacagtcaacactacaaagagaagctcaagatttcgcggtgttagcagacatagatggacgggtcgatatgaagctcacttgtgggacaagctttcttggaacataacacaaaagaagaaagggaagcaaggggcttatgatgaagaagaatctgctgccagagcatatgatttagctgcacttaagtattggggaacttcaactttcacaaattttccaatatcagattatgagaaagagatacaaataatgcagactatgaccaaagaggagtatttggccactttaaggagaaagagcagtggcttttcaagaggtgtatcaaagtataggggtgttgcgaggcaccaccacaatggtagatgggaagcaagaataggaagggtttttggaaacaaatatctctaccttggaacctacagcacccaagaggaagctgcgcgtgcttatgacatagcagccattgagtacagaggaattcatgctgtaacaaactttgatttgagcacttacataaaatggttaaagccttcaggaggaggcaccctagaagcaaatcttgaatcacatgcagcactagagcatcaaaaggtggcatccccatctaattatgctctaacagaagagtctaagtctttggcccttcacaacagttttttcagtccatattctctggattcccctgtaaagcatgaaagatttggaaacaaaacctaccaattctcaagcaataagtcatcttctcccactgcacttggtctccttctccgctcttcgttatttagggaattagttgaaaagaattcaaatgtttctggagaagaagatgatggggaagccacaaaggatcaacagacacaaatagctactgatgatgatctgggtggaatcttcttcgatagctttagtgatattccatttgtgtgtgaccccaatagatacgacttggaattgcaagaaagagacctgcactcaatattttga

SEQ ID NO: 253 - DNA, 1170 bp, Glycine max
atggtaatgatgaaagagaatattattgaagagaagcttggaaggagccaaatgtctatggtagaaggtgagttccaaggaacatggggtgtcaagagacgacgaagagaggttgctgcagcagcaagcagcggtgatgataaccaccaccagcagttaccacagcaagaagttggtgaaaattcttcaatcagcacaacaaagagaagctcaagatttcgcggtgttagcagacatagatggacgggtcggtatgaagctcacttgtgggacaaactctcttggaacataacacagaagaagaaagggaagcaaggggcttatgatgaagaagaatctgctgccagagcatatgatttagctgcacttaagtattggggaaattcaactttcaccaattttccaatatcagattatgagaaagagatagaaataatgcagactatgactaaagaggagtatttggccactttaaggagaaagagcagtggcttttcaagaggtgtatcaaagtatcggggcgttgcaaggcaccaccacaatggtagatgggaagcaagaataggaagggtttttggaaacaaatatctctaccttggcacctacagcacccaagaagaagctgcgcgtgcttatgacatagcagccattgagtacagaggaattcatgctgtaacaaactttgatttgagcacttacataaaatggttaaagccttcaggaggaggcaccccagaagaaaatcttgaatcacatgcagtactagagcatcaaaagttggcatccccatctaattatgctctaacagaagagtctaagtctttggtccttcccaacagttttatcagtccagattctctggattcacctgtaaagcatgaaagttttggaaacaaaacctaccaattctcaagaaataagtcatcttctcccactgcacttggtctccttctgcgctcttcattatttagagaattggttgaaaagaattcaaatgtttctggagaagaagctgatggggaagtcacaaaagatcaacagccacaactagctagcgatgatgatctggatggaatcttcttcgatagctttggcgatattccatttgtgtgtgatcccactagatacaacttggaattgcaggaaagagacctgcactcaatattttga

SEQ ID NO: 254 - DNA, 1179 bp, Medicago truncatula
atggcaatgttgatagaaaacgaagtcatgtgtttaggaaagagtcaaagatccatggatggaaaagaggtaaaaggagcacgtcgtgttaagagacaaagaagagatgctattgtaccaaaaataggtgatgatgctaacaagatggcacagaaacaagttggagaaaattctacaactaacacttcaaagagaagctcaagatttcgtggtgttagcaggcatagatggacgggtcgatttgaagctcacttgtgggacaagctttcttggaacacaacacaaaagaagaaagggaagcaaggggcttatgatgaagaagaatctgctgcaagagcatatgatttagctgcacttaagtattggggaacatcaactttcactaattttccgatatcagattatgataaagagatagagataatgaatactatgaccaaagaggagtacttggccacattaagaagaaaaagcagtggcttttcaagaggtgtctcaaagtatagaggtgttgcaaggcaccatcataatggtagatgggaagcaaggatagggagagtttttggaaacaaatatctctatcttggaacctatagtacacaagaagaagctgcacgtgcttatgatatagctgcaattgagtacagaggaattcatgctgtgaccaattttgaattgagtagctacataaaatggttaaagccagaaactactacagaagaaaatcatgaatcacaaatattacaaaaagagtctcgaacattagcaccccctaataactctactctattgcaagaatcaaagttattagcccttcaaaagagctttttcattccaaatgacctgaattcaactgaaaagcaagaatcatcatttgaaaacaaaaactatcatttcttgagcaacaagtcaacttctccaaccgcgcttagccttctccttcgctcttcgttgtttagagaattacttgaaaagaattcaaatgtatctgaggatgaagttacaaaagagcaacaacaacaacaaataactagtgatgatgaacttggaggaatcttctatgatggtattgacaatatttcatttgactttgatcccaacagctgcaacatagaattgcaagaaagagacttgcattcaatatcttgtttatatcaatacttaaattttggacaataa

SEQ ID NO: 255 - DNA, 1161 bp, Populus trichocarpa
atgatgatgataaagaatgaagaaaacccaggaaggcgccgcggatgcattgcagacagtgaagctcaggtagctcggtgtgtcaaaaggcggcgaagggatcctgctatagttgcactcggaagtgacgataatcaaagtcagcagcagatgccccagaaacaaactgatcaaacttctgctgctaccactgtgaagagaagctcaagatttcgtggcgtcagcagacatagatggacaggtcggtttgaagcccacctgtgggataagctctcatggaatgtaacacagaagaagaaagggaaacaaggagcttatgatgaagaagaatccgcggcgagagcatatgatttggctgctttgaagtattggggaacatcaacttttaccaattttccgatatcagattatgagaaagagattgagataatgcaaactgtaacgaaagaggagtatttagcatctctaagaagaaagagcagcggtttttcaagaggtgtatccaagtataggggagttgcaaggcaccatcacaatgggagatgggaagcgagaatagggagagttttcggaaacaaatacctttaccttggcacatacagcacgcaagaggaggctgcacgtgcttatgacattgcagcaattgagtacagagggatcaatgcggtgacgaactttgacttgagcacttatatcagatggataaagccaggagtagctgctcaagctgctgcaaatgaactacagacagtcacagatcctcagacagcagcgacattgactgatacctacactccaagagaggaaaccaaaccctcactgtttctacctaatcagttcactgcagattacctgaactccccaccaaagctagacgcatttcagaacaatatctttgtagattcttccaacaagacttcatcgcccactgccctcagcctcctcctacggtcttcggtatttagagaattggttgagaagaattcaaatgtttgtgaggaggaaactgatgggaatgagataaagaaccaaccaatggcaggtagtgatgatgaatatggtgggatattttatgatggaattggagatattccatttgtttactcttctaacaaatacagcctagggttggaagaaagagaactccagttcgtcttataa

SEQ ID NO: 256 - DNA, 1119 bp, Ricinus communis
atggaaatgatgatggtgaagaatgaagagatctcaggaaggcgccgtgcgagtgttacagaaagtgaggcttacgtagctcgttgtgtcaaaagacggcgcagagatgcagctgtagttacagttggtggtgatgacagtcaaagtcatcagcagcagcagcagcagcagccagagcaacaggctcatcaaatttctgctgctaccaccgtgaaaagaagttcaagatatcgtggtgtcagcaggcatagatggacaggcagatttgaagctcacctttgggataagctctcgtggaatgtaacacaaaagaagaaaggaaaacaaggagcttatgatgaagaagaatctgcggcaagggcatatgatttagctgcattgaagtattggggaacatcaactttcaccaattttccgatatcggattatgagaaagaaattgagataatgcaaactgtaacaaaagaggaatatttggcctcgttaagaagaaagagcagtggcttctcaaggggggtgtccaaatacaggggagttgcaaggcaccaccataatgggagatgggaagcaagaatagggagagtttttggaaacaaatacctttatcttggcacctatagcacacaagaggaggccgctcgtgcatatgacattgctgcaattgaatatagaggaatcaatgcagtgaccaactttgatttgagtacttacatcagatggctaaagccagaagttgctgcccaagtcgcagcaaatgaaccgcagactgttgcagagtctcggatgctgccatcgatcaataaccgtattgcaagagaagaatctaaaccttcattcttcagcgctactcctttcagtttagattgctggagttaccctcgtaaacaagaagagttccaaaacagaactcccattaccccttgcagcaagacgtcatcacccactgcacttagtctcctccttcggtcctcgatattcagggaattagttgagaagaattccaatgtctctgaagatgaaaatgaaggggaagagacgaagaaccaatcacaaataggcagtgatgatgagtttgggggactgttttacgaaagaattggtgacatcccatttatttaa

SEQ ID NO: 257 - DNA, 1137 bp, Brachypodium distachyon
atggccaagcaacgcacggacagcgccggcaccgatgccgccgccgtccaattgacgaagccgaagcggacgcggaagagcgtgccgcggcgggagagcccctcgcgccgcacctcggcgtaccgcggcgtcacgcggcaccggtggacggggcggttcgaggcgcacctgtgggacaagaacacctggacccagtcgcagaggaagaagaagggcaggcaagtttatctcggggcgtacggcggcgaggaagcggcggcgcgcgcctacgacctggcggcgttgaagtactggggccgcgacaccgtcctcaacttcccgttgtctaactacgacgaagagtggaaagaaatggaggggcagtccagggaagaatacatcggatccctccggaggaaaagcactggcttctcaagaggggtgtccaagtacagaggcgtcgcaaggcatcaccacaacggcaaatgggaggcgaggattgggcgtgtctacggcaacaagtatctctacctgggcacatatgggacgcaggaggaggcggccatggcgtacgacatcgcggcgatcgagcaccgcgggctcaacgccgtcaccaacttcgacgtcagccgctacatcgactggcaccgccgcctctgccgcgacctcggcgacaacatcatcacacccctaacgaacccaaccgtcgacctcgaggaagccatggccggcgacgacgacgacggccaatttctgctcccgtcccaggcgacgacgccgccgtccacgtcgtccgcgctcggcctgctgctgctgtcgccgaggctcaaggaggtgatcgagggatcaggggccgcgagcgcgatggccgcgtcgacttccgagagcagcgccgccggctcccccccgccgtcttggtcttcgtcttcctgttccccttccccgccctcgccctcgcactcgccgccggagacccagcagaagcagcagcagcaggaatacggcgcttcggctgcggcggcgcggtgcagcttcccggacgacgtgcagacgtacttcgggtgcgaggacggctgcgcggaggtggacaccttcttgttcggggacctgagcgcctacgccgcgcccatgttccagttcgagctgctggacgtttga

SEQ ID NO: 258 - DNA, 1323 bp, Sorghum bicolor
atggccaggccgcgcaagaacgccggtaccgacgaggataatcctaacgccgccacgggcgtcagcgtcaccgggaagccgccgaagctgaagcgggtgcggaggaagggcgagccgcgggagagcagcaccccgtcccagcgcagctccgcgtaccgcggcgtcacacggcaccggtggacggggcggttcgaggcgcacctgtgggacaaggacgcccgcaatggctcccggaacaagaaaggcaagcaaggtgcgtacgacgacgaggaagcggcggcgcgcgcgcacgacctggcggcgctcaagtactggggccccgccaccgtcctcaacttcccgctgtgcggctacgacgaggagctgagggagatggaggcgcagcccagggaggagtacatcgggtcgctgcgtcggcggagcagcggcttctcgcgaggggtgtccaagtacaggggcgttgccaggcatcatcacaacgggcgatgggaggcgaggatcgggcgcgtgctgggcaacaagtacctctacctcggcactttcgcaacgcaagaggaggcggcggtggcgtacgacatcgccgctatagagcaccgtggcctcaacgcggtcaccaacttcgacatcagccactacgtcaatcactggcatcgacactgccacggcccctccgacgacagcctcggcgtggtggtggacgacgtcgccgcgttccagctaccagatgacctgcccgagtgcccggcggccgccatcggcgtcgaggagaccacgggcggcgacgcggaattccacaacggcgaggagggctacctgcagcaccacaccagcggacccttcggcgcgcagcagcagcttcctgacgagacgggagcgctagcggctcatcaaatggcgccaaattcgtcggcgctcgacatggtgttgcagtctcccaagttcaaggagctgatggagcaggtctccgcggcggcggcggcggtggcctccgagagcagcatcggcggcagcatgagcagcagctcgccgtcgccgtctttgtcctcgttctcgccttcgcctctgcagctgccatcgccgtcgtctttgtcctcgttctcgccttcgtcgcctctgcagcagccatcgccgccgctgcagcagcctgagttcgtcgaaggagcgccggcggctcggtgcagcttcccggacgacgtgcagacgttcttcgatttcgagaacgagagcgacatgagcttcatgtacgcggaggttgacacgttcctcttcggggacctgggcgcgtacgcggcgccgatattccacttcgacctagacgtgtga

SEQ ID NO: 259 - DNA, 1532 bp, Zea mays
ccgctgctcaccccgtcctagacgcgaggcgacgacgcctccctatccctctcctccgcaatggccaggccccgcaagaacggcggtaccgacgaggatgatgctaacgccgccacgggagccaccgggaagccgaagaagctgatgaagcgggcgcggaggaagagcgagagcccctccccgcgcagctccgcgtaccgcggcgtcacacggcaccggtggacggggcggttcgaggcgcacctgtgggacaaggacgcccgcaacggctcccggagcaagaaaggcaagcaagtttatctcggcgcgtacgacgacgaggacgcggcggcgcgcgcgcacgacctggcggcgctcaagtactggggccccgccggcaccgtcctcaacttcccgctgagcggctacgacgaggagcggagggagatggaggggcagccccgggaggagtacgtcgcgtcgctgcggcggcggagcagcggcttcgcgcgaggggtgtccaagtacaggggcgttgccaggcatcatcacaacgggagatgggaggcgaggatcgggcgcgtgttaggcaacaagtacctctatctcggcacttacgcaacacaagaggaggcggcagtggcgtatgacatggcggctatagaacaccgcggcttcaacgcggtcaccaacttcgacatcagccattacatcaaccactggcatcgacattgccatggcccctgcgacggcagcctcggcgcgatggacgtcgcaccgaacgtctcgctcgaactagacctactcgagtgcccggccaccgtcggcctcggcctcgaggagaccacgggcgacgatgaattccacaaccgcgaggactacctggggcaccttttcggcgtgcagcagcttcccgacgagatggggccgccggctcatcagatggcaccagcatcgtcggcgctcgatctggtgttgcagtcgcctaggttcaaggagctgatgcaacaggtttccgcggcgggagcctccgagaccaacggcggcagcatgcgtagctcgccatcaacgtccctgtgttcgttctcgccttcgcctctggagctgccatcgccgccgctacagcaacctactgaattcatcgatggcgcgccgccgcggtgcagcttcccggatgacgtgcagtcgttcttcgatttcaagaacgataacgacatgagcttcgtctacgcggaggttgacacattcctcttcggcgacctaggcgcatacgctccgccaatgttcgacttcgacctgtacgagtgatcaggatccgactgccagcgttccaagacgccagtgttgttaaaatggcttcataatttttgtttatgatgatgatgagatgactgctatcaaggtttacttgaaagaggtaggattagttatttattctcgcccttttttcaaatagctagaagaggaaaatatgcttctctttttttcttttttccctaaaaggctcaaaggtgtatacaagtcgtcacgaagaactaattgacattgatgac

SEQ ID NO: 260 - DNA, 977 bp, Arabidopsis lyrata
atcctttattattctcattcaccggtaatggcaaaagtctctcggaggagcaagaaaacaatcgttgaagatgaaatcagcgataaaacagcgtctgcatctgaggctgcgtccattgtctttaaatccaaacgcaaacgtaagtcgccgcctcgaaacgctcctcctcaacgcagctccccttatagaggcgtcacaaggcatagatggactgggagatacgaagcgcatttgtgggataagaacagctggaacgagactcaaaccaaaaaaggacgacaagtttatataggggcttacgacgaagaagaagcagcagcacgtgcctacgacttagcagcattgaagtactggggacgagacacactcttgaacttccctttgctgatttatgacgaagacgtcaaagaaatggaaggccaatccaaggaagagtatattggatcattgagaagaaaaagtagtggattttctcgaggtgtatcaaaatacagaggcgttgcaaggcatcaccataatgggagatgggaagctagaattggaagggtgtttggtaataaatatctatatcttggaacatacgccacgcaagaagaagcagcaatcgcctacgacatcgcggcaatagagtaccgtggacttaacgccgttaccaatttcgacgtcagccgttatctaaaccctgacgccgccgattctaagccaattcgaaacgatcccgaatcgtcggatgataacaaatgtccgaaatcagaggaaataatcgaaccatctacatcgcctgaagctattacaactcgccggagctttcccgacgatatccagacgtattttgggtgtcaagactccggcaagttagcgacggaggaagacgttattttcggtggtttgaattcattcataaatcctggtttctataacgagtttgattatggaccttgatcgtatttctttacaagttttgttttgattatcta

SEQ ID NO: 261 - DNA, 1082 bp, Arabidopsis thaliana
ctctcattttcataattccattttcaggattgtctctcaatcttttattcttctcattcaccggtaatggcaaaagtctctgggaggagcaagaaaacaatcgttgacgatgaaatcagcgataaaacagcgtctgcgtctgagtctgcgtccattgccttaacatccaaacgcaaacgtaagtcgccgcctcgaaacgctcctcttcaacgcagctccccttacagaggcgtcacaaggcatagatggactgggagatacgaagcgcatttgtgggataagaacagctggaacgatacacagaccaagaaaggacgtcaagtttatctaggggcttacgacgaagaagaagcagcagcacgtgcctacgacttagcagcattgaagtactggggacgagacacactcttgaacttccctttgccgagttatgacgaagacgtcaaagaaatggaaggccaatccaaggaagagtatattggatcattgagaagaaaaagtagtggattttctcgcggtgtatcaaaatacagaggcgttgcaaggcatcaccataatgggagatgggaagctagaattggaagggtgtttgccacgcaagaagaagcagcaatcgcctacgacatcgcggcaatagagtaccgtggacttaacgccgttaccaatttcgacgtcagccgttatctaaaccctaacgccgccgcggataaagccgattccgattctaagcccattcgaagccctagtcgcgagcccgaatcgtcggatgataacaaatctccgaaatcagaggaagtaatcgaaccatctacatcgccggaagtgattccaactcgccggagcttccccgacgatatccagacgtattttgggtgtcaagattccggcaagttagcgactgaggaagacgtaatattcgattgtttcaattcttatataaatcctggcttctataacgagtttgattatggaccttaatcgtattttctacaagttttgttttgattatctacacaatacatcaaatattatttcttagtgatgatgataacattctatcttaaagctctcaaaaatttctt

SEQ ID NO: 262 - DNA, 1196 bp, Arabidopsis lyrata
attccatcaatttctcatctttgttgttttcctcttctttatgtacatcgccgtcgaagtttctccggtaatggaagagatcacacggaagagcaagaaaacatccgttgagaatgaaaccggcgatgatcagtcagcaacatcagtagtcgttaaagctaaacgtaaacgtcgatcgcaaccacgagacgctcctccacaacgcagctccgtccatagaggcgtcaccaggcatcgatggactggaaggtacgaagcacatttgtgggataagaatagttggaacgagactcagagcaagaaaggaagacaaggggcatatgacgaggaagatgcagcagcacgtgcctacgacttagcagcattgaaatattggggacgagacaccatcttgaatttccctctgtgtaattatgaagaagacatcaaggaaatggaaagccagtcaaaggaagagtatattggatctttgagaaggaaaagtagtgggttctcacgtggtgtatcaaaatacagaggcgttgcaaagcatcaccataatgggagatgggaagctcgaattggaagagtgtttggcaataaatatttataccttggaacttacgctacacaagaagaagcggctatagcgtatgacatcgcagcaatcgagtaccgtggacttaatgccgttactaacttcgacatcagccgttatatgaaactcccggtgccggagaaccctatcgacgccgcgaataatctcctggagagtccgcattctgattccagcccatttataaaccctactcacgagtctgatttatcacagagtcaatcttcctcagacgataacgatgatcggaaaacaaagctcttaaagtcgtcacctttaaatgcagaggaagtaatcggaccatcgacgccaccggagattgctccgcctcgtcggagcttcccggaagatatccagacgtatttcgggtgtcaaaactccggcaagttaacgacggaggaagatgacgttatcttcggtgatttagattctttccttacgcctgatttctacagcgagttaaatgattgctaaagtgttcttctgatttgataagttttgtttttagttttttggaatctcggttgtgaaaatcagcattgacacatatcggttattctttcttgtgacaatcttattataataaagtttgaatcttttt

SEQ ID NO: 263 - DNA, 1114 bp, Thellungiella halophila
gatcgtatatgctcattaaaagtttgaaaccctcttttcaccattgtcgctcctcattcattcttctctcttaccgggaatggcaaaagtctctcagcggagcaagaagacaatcgtcaacgacgaaatcagcgataaaaaagcggttgcggttgcgtctgtgtcttcgtccgctttccttaaatcaaaacgcaaacggaagctgccgccccaaaacgctccacctcaacgcagctcctcctacagaggcgtgacaaggcatagatggacggggagatacgaagcgcatttgtgggataagaactgctggaacgagacgcagaccaagaaaggacgtcaagtttatcttggggcatatgacgaggaagaagcagcagcacgtgcctacgacttagcggcattgaagtactggggacgagacacactcttgaacttccctctacctacttatgaagaagacgtcaaagaaatggaaggccattccagggaagagtacattggatctttgagaaggaaaagtagtgggttttctcgtggtgtatcaaaatacagaggcgttgcaaggcatcaccataatgggagatgggaagctcgaattggaagggtgtttggtaataaatatctataccttggaacatacgcaacgcaagaggaagcagccagagcatatgacatcgcggcaatagagtaccgtggacttaacgccgttaccaacttcgacgtcagccgttatctaaatctaccggaatcgaaaaaccctagcgccgccgcaaatcatctcccggatgaatccgattattacgattctatgcccgttcgaaacccaaaccacgagccaagatcaccagacggtcaaacttcgtcagaggataacgactatacgaaaacagaggagacactcgacccggaagctattccatctcgccggagctttcccgacgatatccagacgtattttgggtgtcaggattccggcaagttagcgacggaggaagacgttattttcggtggttttaattctttcataaatcctggtttctataacgactttgattatgcgccttgatagtgttttgttgaaaagttttttttgtcccgaaaaaaaaaaaaaaaa

SEQ ID NO: 264 - DNA, 1220 bp, Arabidopsis thaliana
attccatcaatttctcatccttgttgttttcttcttcttcttcttcctcttcttttatgttcatcgccgtcgaagtttctccggtaatggaagacatcacacggcagagcaaaaaaacttcggttgagaatgaaaccggcgatgatcagtcagcaacatcagtagtccttaaagctaaacgcaaacgccgatcgcaaccacgagacgctccaccccaacgtagctccgtccatagaggcgtcacaaggcatcgatggactggaaggtacgaagcacatttgtgggataagaatagttggaacgaaactcagaccaagaaaggaagacaagtatatttaggggcatatgacgaggaagatgcagcagcacgtgcctacgacttagcagcattgaaatattggggacgagacaccatcttgaacttccctttgtgtaattatgaagaagacatcaaagaaatggaaagccagtcaaaggaagagtatattggatctttgagaagaaaaagtagtgggttttcacgaggtgtatcaaaatacagaggcgttgcaaagcatcaccacaatgggagatgggaagctcgaatcggaagagtgtttggcaataaatatttataccttggaacttacgcgacgcaagaagaagcagctatagcgtacgatatcgcagctatcgagtaccgtggactcaacgccgttactaacttcgacatcagccgttatctgaaactcccggtgccggagaaccctatcgataccgcgaataatctcctcgagagtccgcattctgatcttagcccatttataaaacctaaccacgagtctgacttatcacagagtcaatcttcgtcagaggacaacgatgatcggaaaacaaagctcttgaagtcgtcacctttagtggcagaggaggtaatcggaccatcgacgccacctgagattgctccgcctcgtcggagcttcccggaagatatccagacgtatttcgggtgtcaaaactccggcaagttaacggcggaggaagatgatgttatcttcggtgatttagattctttccttacgcctgatttctacagcgagttaaatgattgctaaagtgttgttcttctgataagttttgttttttagttgttcagaatctcggttgtgaaaatcaacattgacacatcgattattctttcttgtgacaatcttatataataaagtttgaatctttttaac

SEQ ID NO: 265 - DNA, 900 bp, Glycine max
atggcgaagaaatcacagaaaagcctcaaaaacaacaataacaacaacaccactaggaagcgcacacgcaaaagcgtcccaagagactcacctcctcaacgaagctcaatctataggggtgtcacaaggcatcgatggactggtcgatacgaggctcatttgtgggataagaattgctggaatgaatcacagagcaagaaaggaagacaagtatatctaggggcatatgatgatgaagaagccgcagcacgtgcctatgacttggcagcattgaagtactggggccaagataccattctcaattttccattatcaaattatgaggagaagctcaaggagatggaaggccagtcaaaagaagaatatattggatccttgcgaagaaaaagcagtgggttctctcgaggagtttcaaaatacagaggcgtagcaagacaccaccataacggaagatgggaagctcgaattggaagggtctttggcaacaaatatctataccttggaacttacgctacacaagaagaagcagccgcagcatatgacatggcagcaatagaatacagaggacttaacgccgttacaaactttgacctgagccgttatatcaattggccacgtcctaaaacagaagaaaatcatcaaaatactcctagcaaccaaaatgtaaactctaatgctgaactcgagctaggttcggctagtgacgagatcacagaagagggcgtagcacgatcttcagagtcagagtcaaatccttctcgtcgcacattccctgaagacattcaaacaatttttgaaaataatcaagattcaggcatctacattgaaaatgatgatatcatttttggtgacttgggctcgtttggtgcaccaatttttcatttcgaacttgatgtttag

SEQ ID NO: 266 - DNA, 1186 bp, Brachypodium distachyon
cacaatggcaaagccccgcaagaactccgccgccgccaacaacaacaacaacgacaacagcaccaacgctaacaacgccgtcgccgaggctgcggcggcggatgtgcgcgcgaagccgaagaagcgcacccggaagagcgtgccgcgggagtccccctcgcagcgcagctccatctaccgcggcgttacacggcaccggtggacggggcggttcgaggcgcacctgtgggacaagaacagctggaacgagtcccagaacaagaagggcaagcaagtttacctcggagcatacgacgaggaggaggcagcggcccgggcgtatgacttggcggcattgaaatactggggccccgacaccatcctcaacttcccgctatctgtatacgatgatgagttgaaagaaatggaggggcagtcaagggaagagtatattgggtccctgaggaggaaaagtagcgggttctcaagaggagtctccaagtaccgcggtgtcgccaggcatcaccacaacgggagatgggaggcccggatcggccgtgttttcggcaacaagtatctctacctcggcacctacgcgacgcaggaggaggccgcgatggcgtacgacatggcggcgatcgagtaccgcggcctgaacgccgtcaccaacttcgacctcagccgctacatcaagtggctccgccccggcggcggcgtcgactcggctgccgccgccgccgcccgcaacccgcacccgatgctggccggcctggcgacccaggaggagttaccagcgatcgatcacctcctcgacggcatggcgttccagcagcacggcctccattcttcttcggcggcggcggcagcagcgcaggagttccccctgccgccggcgctcggccacgcccccacgacgtcggcgctgagcctcctgctgcagtcgcccaagttcaaggagatgatcgagcggacgtccgccgcggagacgacgacgacggccacgacgacgtcgtcgtcttcgtccccgcgtccggcggcgtcgccgcagtgcagcttcccggaggacatccagaccttcttcgggtgcgacgacggcgtgggcgtgggagtcggtgcagtgggatacaccgacgtggacggcctcttcttcggggacctctccgcgtacgcgtcgtcgacggcgttccatttcgagctcgacttgtga

SEQ ID NO: 267 - DNA, 1197 bp, Sorghum bicolor
atggcgaagcctcgcaagaacagcgccgccgccaacaacaacaacagcagcagcaacggcgccggcgacctgacgccgcgcgcgaagccgaagcgcacgcggaagagcgtgccccgggagtcccccacgcagcgcagctccgtctaccgcggcgtcacacggcaccggtggacggggaggttcgaggctcacctgtgggacaagaacagctggaacgagtcccagaacaagaagggcaagcaagtttacctcggcgcgtacgacgacgaggaggcagcggcgcgggcgtatgacttggcggcattgaagtactggggccccgacaccatcctcaacttcccggcgtctgcatatgaaggagagatgaaaggaatggagggccagtccagggaagagtatattggatccttgaggaggaaaagcagtgggttctccagaggtgtctccaaataccgaggtgtcgcgagacatcaccacaacgggagatgggaggcgaggatcggtcgtgttttcggaaacaagtatctctacctcgggacttacgcgacgcaggaggaggcggcgatggcgtacgacatggcggcgatcgagtaccgtggcctgaacgccgtcacaaacttcgacctcagccgctacatcaagtggctccgcccgggcgccggcgggatggcagccgcggcggcggcggcgcagaacccgcacccgatgctgggcggcctggcgcagcagctgctgctgccgccgccggcggacaccaccaccaccgacggcgccggcgccgcggcgttccagcacgaccaccacggcgccgaggcgttcccgctgccgcccaggacgtcgctgggccacacgcccacgacgtcggcgctcagcctgctgctgcagtcgcccaagttcaaggagatgatccagcggaccgagagcggcaccaccaccactaccaccacgacatcgtcgttgtcctcgtcgccgccgcccacgccgtccccgtccccgccgcggcggtcgccagcgccgacgcagccgccggtgcaggcggcggccagggacgcctcgccgcaccagcgcggcttccccgaggacgtacagacattcttcggctgcgaggacaccgcgggcatcgacgtggaagccctcttctttggcgacctcgccgcgtacgcgacgccggcgttccacttcgagatggacttgtag

SEQ ID NO: 268 - DNA, 1736 bp, Zea mays
gccggccaatgagatggagcagagcaaagaatttcagagagagagagagagaggagagagaaaggccggcctgtctctcccgtctctcttctttcctcctcctttgctcatttggcatttgccctgctctccaaacatcaactaaatttggccgccccatcaccaatcccttcccagtctctccctccgcgtcgtctttaaaacggccacctccaaaggccccctgtagttggccacccacctctccctcctcctttcttctgtcgtctctctctccgcacgcgcaatggcgaggcctcgcaagaacagcgccgccgccgccaacaacaacaacagcaacaccaccaacgccggcaacgccgccgtcgacctcgcggcgcgcgtcaagccgaagcgcacgcggaagagcgtgccccgggagtccccctcgcagcgcagctccgtctaccgcggcgtcacacggcaccggtggacggggaggttcgaggctcacctgtgggacaagaacagctggaacgagtcccagaacaagaagggcaagcaagtttacctcggcgcgtacgacgacgaggacgcagcggcgcgcgcgtatgacttggcggcattgaagtactggggccccgacaccatcctcaacttcccggcgtctgcatatgaagcagagttgaaagaaatggaggggcagtccagggaagagtatattgggtccttaaggaggaaaagcagtgggttctccagaggtgtttccaaataccgaggtgtcgcaaggcatcaccacaacgggagatgggaggcgaggattggtcgcgtcttcggaaacaagtatctctacctcgggacttacgggacgcaggaggaggcggcgatggcgtacgacatggcggcgatcgagtaccggggcctgaacgccgtcactaacttcgacctcagccgctacatcaagtggctccgcccgggcgccggcgccgcgcagaacccgcacccgatgctggacggcctggcgcagcagctgctgctgtcgccggagggcaccatcgacggcgccgcgttccaccagcagcagcacgaccaccgccagcagggcgccgccgagctcccgctgccgcccagggcgtcgctgggccacacgcccaccacgtcggcgctcggcctgctgctgcagtcgtccaagttcaaggagatgatccagcgggcgtcggcggccgagagcggcaccaccaccgtcaccaccacgtcgtcgtcgtcgtcgcagccgcccacgccgacgccgacgccgtcgccatcgccacctccgacgccgccagtgcagccggccagggacgcctcgccacagtgcagcttccccgaggacatacagaccttcttcggctgcgaggacgtcgcgggcgtcggcgccggcgtcgacgtggacgccctcttcttcggcgacctcgccgcgtacgcgtcgccggcgttccacttcgagatggacttgtagctcatcacacgccattactcgttaatcactatctgggtttttttttttgtcgataggagaatggagctctctcgccatttgagaaccaagaaaatggtgagacacacaaaacaagagaggcagcagaacagacagacggcgcctagtctgttttgagagatttatttacagtggtaactagtgacatttactgaacggttaagattgtattattcaaatttttttcacattggtaacaagggattgtttcatttgtttc

SEQ ID NO: 269 - DNA, 1089 bp, Glycine max
atggccaaaaaatcacagctgcgtacccagaaaaacaatgctactaatgacgatattaatcttaacgcaaccaacactgtaatcaccaaggtgaaacgaacaaggagaagtgtccctagagactccccacctcaacgcagctcaatataccgaggagtcactaggcaccgatggactggccgatacgaagctcatttgtgggacaagcattgctggaatgaatcacagaataaaaaaggacgacaaggcgcttatgataatgaagaggcagcagcacatgcttatgatctagcagcactgaaatactggggtcaagataccattcttaattttccgttatcaaactacctgaatgaactgaaagaaatggagggtcaatcacgggaagagtatatcggatcgctgaggaggaaaagcagtggtttttctagggggatttctaaatacagaggtgttgcaaggcatcatcataacggaaggtgggaggctcggattggcaaagtttttggcaataaatatctttatctcggaacttacgctacccaagaagaagctgctactgcctatgacctggcagctatagaataccgtggactcaatgctgtcaccaatttcgatctcagccgttacattaagtggcttaagcccaacaacaccaacagcaacaatgaccagattagtattaatctcactaacataaataataattgcactaacaacttcatcccaaaccctgatcaagaacaagaagttagtttcttccacaaccaggattcactcaataatactattgtagaggaagccacgttggtgccacatcagcctcgtccagcaagtgccacgttagcattggagcttctacttcagtcatccaagttcaaggaaatggtggaaatgacatccgtggccaatctttcaacacagatggaatctgatcagttgccacagtgcacatttcctgatcacattcagacatactttgagtatgaagattccaataaatatgaggaaggggatgatctcctgttcaagttcagcgagttcagctccattgtgccgttttaccattgtgacgagttcgagagttga

SEQ ID NO: 270 - DNA, 1298 bp, Glycine max
atggccaaaaaatcacagctgcgtacccagaaaaacaatgttaccaccaatgacgataataatcttaacgtaaccaacactgtgaccaccaaggtgaaacgaacaaggagaagtgtccctagagactccccacctcaacgcagctcaatataccgaggagtcactaggcaccgatggacaggccgatacgaagctcatttgtgggacaaacattgctggaatgaatcacagaacaaaaaagggcgacaagtctaccttggcgcttatgacaatgaagaggcagcagcacatgcttatgatctagcagcactgaaatactggggtcaagataccattcttaattttccgttatcaaactacctgaacgaactgaaagaaatggagggtcaatcacgggaggagtatatcggatcgctgaggaggaaaagcagtggtttttctcggggaatttctaaatacagaggtgttgcaaggcatcatcataacggaaggtgggaggctcggattggcaaagtttttggcaataaatatctttacctcggaacttatgctacccaagaagaagctgctactgcctatgacctggcagccatagaataccgtggactcaatgctgtcaccaatttcgatctcagccgttacattaagtggcttaagcctaacaacaacaccaacaacgttatcgacgaccagattagtattaatctcactaacataaacaataataataattgcactaacagcttcaccccaagtcctgatcaagaacaagaagctagcttcttccacaacaaagattcactcaataatactattgtagaagaagtcacgttggtgccacatcagcctcgtccagcgagtgccacgtcagcattggagcttctacttcagtcatcaaagttcaaggaaatgatggagatgacatctgtggccaatctttcatcaacacagatggaatctgagttgccacagtgcacatttcctgatcacattcagacgtactttgagtatgaagattccaatagatatgaggaaggagatgatctcatgttcaagttcaacgagttcagctccattgtgccgttttaccaatgtgacgagttcgagagttgaagaagtcaggtttatataatgcatggaaaaaagaaactctgatatgtttgtttatttgtttaatttgttgattatgttaaagaccatattcataaatctttagctaattaaggtttaagtttttagaagagagatcatgtcattcacaactattataataagtggacttgttttcaatttgtgaa

SEQ ID NO: 271 - DNA, 1160 bp, Medicago truncatula
acctttcaaattaatgcaccattaatactatatataaatatacatctttgctagcttgtttcttcagtatacacttctttttttttccaatggcgaaaaaatcgcagaagcaaatagagaaagacgacaatgcaagcaatgataatgataatctgaatccaagtaacactgtcaccaccaaagcaaaacggacgaggaaaagtgtccctagaacttctccacctcaacgcagctcaatatacagaggagtcactaggcaccgttggacaggccgatatgaagctcatttgtgggacaagaattgttggaatgagtctcagaacaagaaagggagacaaggtgcttatgataatgaggagacggcagcacatgcttatgatctagcagcattgaaatattggggtcaagataccattattaattttccgctatcaaactatcagaaagaactaattgaaatggagagtcaatcaagggaggagtatattggatccttaagaaggaaaagcagtggtttttcacggggtgtatctaaatacagaggtgtagcaagacatcatcataacggaaggtgggaggcacggattggcaaagtttttggcaataagtatctttatctcggaacatatgctacccaagaagaagcagctacagcttatgacatggcagctattgaataccgtggacttaatgctgttaccaatttcgacctaagccgttatattaagtggcttaagcccaacaataacaacaatgacgacaataacaagtctaatattaatctttgtgacattaactctaacagtagtgccaacgactcaaactctaatgaagaattggaatttagcctcgtggacaatgaaatatcactcaataattctattgacgaagccacattggttcaacctcgaccaactagtgccacgtcagccctagagcttttgcttcaatcatctaagtttaaggaaatggtggaaatggcatcaatgacttccaatgtgtcaacgacgttggagtctgatcaattgtcacaatgtgcatttcctgatgacattcaaacgtactttgaatatgaaaatttcaatgatacaatgttggaagacctcaactccattatgcctacgtttcattatgactttgagggtgctgaggttttatag

SEQ ID NO: 272 - DNA, 1044 bp, Glycine max
atggcgaagcagcaaacacacaaaatcaatgcaagcactaacaataacattagcacaactaacactgtcaccgccaaggtgaaacgaacaaggagaagcgtccctagagattccccacctcaacgcagctcaatatacagaggagtcactaggcaccgatggactggccgatacgaagctcatttgtgggacaagaattgctggaatgagtcacagaacaagaaaggacgacaaggtgcttatgacgatgaagaggcggcagcacatgcttacgatctagcagcattgaaatactggggtcaagataccattcttaattttccgttatcgacctaccagaatgaactgaaagaaatggagggtcaatctagggaagagtatattggatcactaaggaggaaaagcagcggtttttctcgtggagtttctaaatacagaggtgttgcaagacaccatcataacggaagatgggaggctcggattggcagggttttcggcaacaaatatctttacctcggaacttacgcaacccaagaagaagctgccacagcatatgacatggcagctattgaatatcgaggagtcaacgctgtgaccaatttcgacctcagccgctatatcaagtggcttaagcccaataataacaacaccacagtcaactctaatcttattgactctaaccctaattgtgagacgaactttacctcaaactctaatcaacaacaaggattcaattttttcaacagacaagagtcattcaataatgaagaagcggcaatgactcagcctcggccagctgttgccacgtcagccctaggacttttgcttcagtcatccaagtttaaggaaatgatggagatgacttctgctacagatttgtcaacaccgccgtcggagtctgagttgccgtcatgcacatttcccgatgacattcaaacatattttgagtgtgaagattcccatagatatggagaaggggatgatattatgttcagcgtgctcaacggctttgtgccccctatgttccattgtgatgacttttga

SEQ ID NO: 273 - DNA, 1056 bp, Glycine max
atggcgaagcagcaaacacacgaaatcaatgcaagcactaacaataacattaacacaactaaaactgtcaccaccaaggtgaaacgaacaaggagaagtgtccccagaaattccccacctcaacgcagctcaatatacagaggagtcactagacaccgatggacaggtcgatacgaagctcatttgtgggacaagaattgctggaatgagtcacagaacaagaaaggacggcaaggtgcttatgacgatgaagaggccgcagcacatgcttatgatctagcagcattgaaatactggggtcaagataccattcttaattttccgttatcgacctaccagaatgaactgaaggaaatggagggtcaatctagggaagagtatattggatcactaaggaggaaaagcagcggtttttctcgtggagtttctaaatacagaggtgttgcaagacaccatcataacggaagatgggaagctcggattggcagggttttcggcaacaaatatctttacctcggaacttatgcaacccaagaagaagctgccacagcatatgacatggcagctattgaatatcgaggactcaacgctgtgaccaattttgacctcagccgctatatcaagtggcttaagcccaataacaacaataacaaagtcaattctaataatcttattgtctctatccctaattgtgcgaccaactttaccccaaactctaaccaacaacaaggattcaattttttcaacagtcaagaatcattcaataataatgaagaagcggcaatgactcagcctcggccagctgctgccacgtcagccctaggacttttgcttcaatcatccaagtttaaggaaatgatggagatgacttctgccatagatttgtcaacaccgccatcagaatctgagttgccgccatgcacatttcccgatgacattcaaacatattttgagtgtgaagattcccatagatatggagaaggggatgacatcatgtttagcgagctcaacggctttgtgccccctatgttccattgtgatgactttgaggcttga

SEQ ID NO: 274 - DNA, 1062 bp, Populus trichocarpa
atggcgaaattatcacagaagaacacaaaaaacacagcaagtaacaataataacacgactaatggcgtgaccaaggtgaaacgaacaaggagaagtgttccaagagactctcctcctcaacgcagctccatttatcgtggcgttactaggcaccggtggaccggccgatatgaagctcatttgtgggataagaattgctggaatgaatcacagaacaagaaaggacgacaaggtgcctatgatgatgaagaagcggcagcgcatgcttatgacttagcagcactgaagtactggggtcctgagacaattcttaattttccgttgtcgacataccaaaatgaactgaaagaaatggagggtcagtcgagagaagagtgcattggatcattgagaaggaaaagcagtggcttttctcgtggagtttcaaaataccgaggagttgctaggcatcatcacaacgggaggtgggaagctcggattggtagagtattcggcaacaaatacctatatctcgggacatatgctactcaagaagaagctgccaccgcttacgatatggcggctatagagtaccgtggcctgaatgctgttaccaacttcgatcttagccggtacatcaaatggctaaaacccaatcaaaataacactgataacaataatggtctggatctccctaaccctatcataggcactgataattcaactcatcctaaccctaaccaagagcttggaacaaccttccttcaaattaaccagcaaacctaccaacctagtgaaactacattaactcaaccacggccagcaacgaatccttcatctgccctagggctcttacttcaatcatcgaagttcaaggagatgatggaaatgacagcagtgacagattgcccaccaaccccaccgtcgggcttagacccgacaccatgtagcttccttgaagacgtgcagacatattttgactgtctcgattcaagtaactacggggatcaaggtgacgacatgatttttggcgacctcaactcgtttgtgccacccatgttccagtgcgatttcgagacataa

SEQ ID NO: 275 - DNA, 1044 bp, Vitis vinifera
atggcgaagctatcacagcaaaaccataagaatagtgcaaacagcaatgctactaatactactctctctgtgacaaaggtgaagcggactcgcaaaactgtccccagagactctcctcctcagcggagctcgatatatcggggcgtcacgaggcatcggtggactggccgatacgaggctcatttgtgggataagaactgctggaatgaatcacagaacaagaaaggaagacaaggtgcctaccatgatgaagaagccgcagcacatgcttatgacttggcagctctcaaatactggggtccagaaaccattctcaattttccgctatcaacatatgaaaaggagttgaaggaaatggagggtctgtcaagagaagaatacattggatccttgagaagaagaagcagcggtttttctcgaggtgtttcaaaatatagaggggttgcaagacatcatcacaatggcagatgggaagcgcggattggcagagtgttcggcaacaaatacctctatcttggcacatatgctactcaggaggaggcagcgactgcatatgatatggctgccatagagtatcgcggtcttaacgcggttaccaactttgatctcagtcgctacatcaaatggttaaagcctaatcaaaataacccatgcgaacagcccaataaccctaaccttgactctaatttgactccaaaccctaatcatgattttggaatcagcttcctgaatcacccacagacttctggtactgctgcctgcagtgaacctccattgactcagaccaggcctcccattgcctcatcggcgcttggccttctacttcagtcctcaaagttcaaagagatgatggagatgacaactgccgccgaccacctatcgacaccgcctgagtctgagctgccacggtgcagcttccctgacgacattcagacgtacttcgagtgccaggattccggcagttacgaggaaggagacgatgttatcttcagtgagctcaactcgttcatacctcccatgttccaatgtgatttcagtgcttaa

SEQ ID NO: 276 - DNA, 828 bp, Populus trichocarpa
atgggaaaaacatcaaagcaaagcctaaagaactctgcaaacactagcattaatcccgcaaccaaggtgaagcggactagaaagagtgttcctcgagactctcctcctcaacgcagctccatctatagaggcgttacaaggcatcgatggaccggacgttatgaggctcatttgtgggataagaactgctggaatgagtcacagaacaagaaaggaagacaaggggcctacgatgacgaagaagcggctgggcatgcctatgacttggcagcattaaagtactggggacaggatactatcctcaattttcctctgtcaacttacgaagaagaattcaaagagatggagggtcattcgaaagaagaatatattggatcactgaggagaaaaagtagtgggttttcacgcggtgtgtccaaatatagaggtgtagccagacaccatcataatggaagatgggaagctcgaattggcagagttttcggcaacaagtacctctaccttggaacatatgccactcaagaagaagcagcaacagcatatgacatggcagctatagagtaccgtggacttaatgctgtgacaaactttgacctaagccgctactcctcaaagttcaaggaaatgttggagagaacatcagcttctgattgccctttgacaccacccgaatccgaccgcgatccgcctcgtaggagcttcccagatgacatccaaacttacttcgattgccaagactccagtagctacactgatggtgatgacattatttttggagacctacattcatttgcttcaccgatttttcattgcgaattggatgggtag

SEQ ID NO: 277 - DNA, 943 bp, Lupinus angustifolius
tggcaaataatgatttttattttgactgatagtgacctgttcgttgcaacaaattgatgagcaatgcttttttataatgccaactttgtacaaaaaagttggtgaggcacatctttgggataaaagtacatggaaccaaaatcagaataagaaaggaaagcaagtttacttgggggcatatgatgatgaggaagcagcagctagagcatatgaccttgctgctctgaagtattggggtccagggactctcattaatttcccagtgactgattatacaagagatcttgaagaaatgcagaatgtttcgagagaggaataccttgcatctttacggcggaagagcagtggtttttcaagaggaatatcaaaatatcgtgcactctccagtcgatgggagccatcatatagtcgttttgctggatctgactacttcaacagtatgcattatggcgcaggtgatgattcagccgcagaaaaagaaaagagacatggtttcgctggagatatttgcagcgaacttaaaacgctggaacagaaagtccaacctactgaaccataccagatgccagagttaggcaggtcccacaatgagaaaaaacatagaagttctgccgtctctgccttaagtatcttgtcgcaatctgctgcttataagagcttgcaagagaaagcatcaaagaaacaggaaaatagcatcgataatgatgagaatgaaaacaaaaatacagtcaataagttggattatggcaaagcagttgagaaatcatcaatcatgacagtgacagtgatcgacttgacattgcaatgggaacagttgtgccattgtgtctcaaagaaatgttttatccatcgatccgttcttgtctgcacgcttttgactgcatacgatactcgttgatccatcatggtaagatcctgtttttgtgagacgtcctcatgggcc

SEQ ID NO: 278 - DNA, 1729 bp, Lupinus angustifolius
cgactctatacgatacaaaacatactctgattttctctctcttagcgttagggtttcgttttcaataaccatggcttcttcttcttccgatcccggtaagtccgaaattggtggcggtgcggcggagacttcggaagctgcggcggtggcggtggcggtgacgaacgaccaatcgttattgtacaggggattgaagaaagcgaagaaagagagaggttgtactgcgaaagaacgcatcagcaaaatgcctccttgtgccgctggaaaacgcagctccatataccgtggagttaccaggcatagatggactggtcgctatgaggcacatcttagggataaaagtacatggaaccaaaaccagaataagaaaggaaagcaagtttacttgggggcatatgatgatgaggaagcagcagctagagcatatgaccttgctgctctgaagtattggggtccagggactctcattaatttcccagtgactgattatacaagagatcttgaagaaatgcagaatgtttcgagagaggaataccttgcatctttacggcggaagagcagtggtttttcaagaggaatatcaaaatatcgtgcactctccagtcgatgggagccatcatatagtcgttttgctggatctgactacttcaacagtatgcattatggcgcaggtgatgattcagccgcagaaagtgagtatgcaagtggtttctgtatagaaagaaagattgatttaactggtcacattaaatggtggggatctaataaaagtcgtcaacctgatgctggaacgagattatcagaagaaaagagacatggtttcgctggagatatttgcagcgaacctaaaacgctggaacagaaagtccaacctactgaaccataccagatgccagagttaggcaggtcccacaatgagaaaaaacatagaagttctgccgtctctgccttaagtatcttgtcgcaatctgctgcttataagagcttgcaagagaaagcatcaaagaaacaggaaaatagcaccgataatgatgagaatgaaaacaaaaacacagtcaataagttggatcatggcaaagcagttgagaaatcatcaaaccacgatggtggcagtgatcgtgttgacattgaaattggaacaactggggcattgtctcttcaaagaaatatctacccactgacgccattcttgtctgcaccgcttttgacagcatacaatactgttgatccatcattggtagatcctgttctatggacatctcttgtgcctatgctttctgctggcctttcttgtcctactcaggttacaaagactgagaccagttcatcttacaccatctttcagcctgagggatgatgtggacattcgattatctgacagtagaaaaggcaaacacctgaaagagctgaactcctatatcaaacagcaacataagcatctgcatctgaactctgaagaactcaagcaggtatgagagaatgctcccatggctttttttttgcaagcttacatgggttttagaggccagagaaaagaaagtagtattactgtgttttaaatgataatatatatacaggaatagcataaatcttttcaagccatacatacatgtgtatcagttgatatcaccaatagaaaattctgtacagagcaagatgtgaaattatgcaagaatatgtttattaatttatttgcataggagtttttgaggtcctaaaaaaaaaaaaa

SEQ ID NO: 279 - protein, 356 aa, Arabidopsis thaliana
MDWEIRGSSLGQKLLEFDSEQERQTRFRAYDSEEAAAHTYDLAALKYWGPDTILNFPAETYTKELEEMQRVTKEEYLASLRRQSSGFSRGVSKYRGVARHHHNGRWEARIGRVFGNKYLYLGTYNTQEEAAAAYDMAAIEYRGANAVTNFDISNYIDRLKKKGVFPFPVNQANHQEGILVEAKQEVETREAKEEPREEVKQQYVEEPPQEEEEKEEEKAEQQEAEIVGYSEEAAVVNCCIDSSTIMEMDRCGDNNELAWNFCMMDTGFSPFLTDQNLANENPIEYPELFNELAFEDNIDFMFDDGKHECLNLENLDCCVVGRESPPSSSSPLSCLSTDSASSTTTTTTSVSCNYLV

SEQ ID NO: 280 - protein, 430 aa, Arabidopsis thaliana
MKKRLTTSTCSSSPSSSVSSSTTTSSPIQSEAPRPKRAKRAKKSSPSGDKSHNPTSPASTRRSSIYRGVTRHRWTGRFEAHLWDKSSWNSIQNKKGKQVYLGAYDSEEAAAHTYDLAALKYWGPDTILNFPAETYTKELEEMQRVTKEEYLASLRRQSSGFSRGVSKYRGVARHHHNGRWEARIGRVFGNKYLYLGTYNTQEEAAAAYDMAAIEYRGANAVTNFDISNYIDRLKKKGVFPFPVNQANHQEGILVEAKQEVETREAKEEPREEVKQQYVEEPPQEEEEKEEEKAEQQEAEIVGYSEEAAVVNCCIDSSTIMEMDRCGDNNELAWNFCMMDTGFSPFLTDQNLANENPIEYPELFNELAFEDNIDFMFDDGKHECLNLENLDCCVVGRESPPSSSSPLSCLSTDSASSTTTTTTSVSCNYLV

SEQ ID NO: 281 - protein, 430 aa, Arabidopsis lyrata
MKRRLTTSTSSSSPSSSVSSSTTTSSPIQSEAPRPKRAKRAKKSSPSGDKSHNPTSPASTRRSSIYRGVTRHRWTGRFEAHLWDKSSWNSIQNKKGKQGAYDSEEAAAHTYDLAALKYWGPDTILNFPAETYTKELEEMQRVTKEEYLASLRRQSSGFSRGVSKYRGVARHHHNGRWEARIGRVFGNKYLYLGTYNTQEEAAAAYDMAAIEYRGANAVTNFDISNYIDRLKKKGVFPFPVNQPNHQEAILVEAKQEIETREAKEEPREEVKQQYVEEPPQEEKEEEKAEQQEAEFVGYKDEGAVVNCCIDSSAIMEMNRCGDNNELAWNFCMMDSGFAPFLTDQNLSNENPIEYPELFNELAFEDNIDFMFDEAKNDCLSLENLDCCVVGRESPTSSSSPLSCFSTDSASSTTTTTSVSCNYLGLFVGSE

SEQ ID NO: 282 - protein, 413 aa, Brassica napus
MKRPLTTSPSSSSSTSSSACILPTQSETPRPKRAKRAKKSSLRSDVKPQNPTSPASTRRSSIYRGVTRHRWTGRYEAHLWDKSSWNSIQNKKGKQVYLGAYDSEEAAAHTYDLAALKYWGPNTILNFPVETYTKELEEMQRCTKEEYLASLRRQSSGFSRGVSKYRGVARHHHNGRWEARIGRVFGNKYLYLGTYNTQEEAAAAYDMAAIEYRGANAVTNFDIGNYIDRLKKKGVFPFPVSQANHQEAVLAETKQEVEAKEEPTEEVKQCVEKEEAKEEKTEKKQQQEVEEAVITCCIDSSESNELAWDFCMMDSGFAPFLTDSNLSSENPIEYPELFNEMGFEDNIDFMFEEGKQDCLSLENLDCCDGVVVVGRESPTSLSSSPLSCLSTDSASSTTTTATTVTSVSWNYSV

SEQ ID NO: 283 - protein, 415 aa, Brassica napus
MKRPLTTSPSTSSSTSSSACILPTQPETPRPKRAKRAKKSSIPTDVKPQNPTSPASTRRSSIYRGVTRHRWTGRYEAHLWDKSSWNSIQNKKGKQVYLGAYDSEEAAAHTYDLAALKYWGPDTILNFPAETYTKELEEMQRCTKEEYLASLRRQSSGFSRGVSKYRGVARHHHNGRWEARIGRVFGNKYLYLGTYNTQEEAAAAYDMAAIEYRGANAVTNFDISNYIDRLKKKGVFPFPVSQANHQEAVLAEAKQEVEAKEEPTEEVKQCVEKEEPQEAKEEKTEKKQQQQEVEEAVVTCCIDSSESNELAWDFCMMDSGFAPFLTDSNLSSENPIEYPELFNEMGFEDNIDFMFEEGKQDCLSLENLDCCDGVVVVGRESPTSLSSSPLSCLSTDSASSTTTTTITSVSCNYSV

SEQ ID NO: 284 - protein, 285 aa, Glycine max
MKRSPASSCSSSTSSVGFEVHHPIEKRRPKHPRRNNLKSQKCKQNQTTTGGRRSSIYRGVTRHRWTGRFEAHLWDKSSWNNIQSKKGKQVYLGAYDTEESAARTYDLAALKYWGKDATLNFPIETYTKDLEEMDKVSREEYLASLRRQSSGFSRGISKYRGVARHHHNGRWEARIGRVCGNKYLYLGTYKTQEEAAVAYDMAAIEYRGVNAVTNFDISNYMDKIKKKNDQTLQQQQTEVQTETVPNSSDSEEAEVEQQHTTTITTPPPSENLHMLPQEHQVGGWV

SEQ ID NO: 285 - protein, 417 aa, Jatropha curcas
MKRSSASSCSSSSSSSSSPSSSSSSACSASSSCLDSVSPPNHHQLRSEKSKSKRIRKIQTKQDKCQTTATTTSPSGGGRRSSIYRGVTRHRWTGRFEAHLWDKSSWNNIQNKKGRQVYLGAYDNEEAAAHTYDLAALKYWGQDTTLNFPIETYSKELEEMQKMSKEEYLASLRRRSSGFSRGVSKYRGVARHHHNGRWEARIGRVFGNKYLYLGTYNTQEEAAAAYDMAAIEYRGANAVTNFDVSHYIDRLKKKGIPLDKILPETLSKGSKESEEIERTSPLPLPSPPSPSITPLHEEIVSPQLLETECPQHPPCMDTCTMIVMDPIEEHELTWSFCLDSGLVPLPVPDLPLANGCELPDLLDDTGFEDNIDLIFDACCFGNDANPADENGKERLSSASTSPSCSTTLTSVSCNYSV

SEQ ID NO: 286 - protein, 443 aa, Ricinus communis
MKRSPTSPCSSSSSSSYSSSSASSSCVGPDDTPVAPGSHHHHDHHQLRSQKSSKRIRKVKKKQQNHNIDQNNTNTTITAPTSARRSSIYRGVTRHRWTGRFEAHLWDKSSWNNIQNKKGRQGAYDNEEAAAHTYDLAALKYWGPETTLNFPIETYPKELEEMQKMSKEEYLASLRRQSSGFSRGVSKYRGVARHHHNGRWEARIGRVFGNKYLYLGTYNTQEEAAAAYDMAAIEYRGANAVTNFDISNYIDRLKKKGILLDQILPDQPLRKCSSESEEAEAEAEVERLPSLPSSILPQEQDTISPQLQCTQLLPSMDSCTMINMDPIEDNELTWSFCLDSGLTLFSVPELPLENACELPDLFDDTGFEDNIDLIFDGCCFGNDDDGGGGANHQEFMVESRGCRVGEVGISGSMEEENGKEMCCSSSSPSCSTTTSVSCCNYSV

SEQ ID NO: 287 - protein, 402 aa, Populus trichocarpa
MKRSSSCSSSSSSSSSSCVASESIHKPKAKRIRKNQKSNQGKSQNAAAAAANNSHNSGKRSSIYRGVTRHRWTGRFEAHLWDKSSWNSIQNKKGKQGAYDNEEAAAHTYDLAALKYWGSETTLNFPIETYTKEIEEMQKVTKEEYLASLRRQSSGFSRGVSKYRGVARHHHNGRWEARIGRVYGNKYLYLGTYNTQEEAAAAYDMAAIQYRGANAVTNFDVSNYIERLRKKGIPIDRILQEQQLLNNSVDSSVEVEVEQPTPPPQQQQEEQEQKIVSSSSQLQCSQLNSSLDGTPPMVIMDTIEEHELAWSFCMDSGLSLTMPDLPLENSCELPDLFDHTGFEDNIDLIFDACCYGKEANPAGYTLEDNSTGGVEEDRLSSDSVSNSPTSSTTTSVSCNYSV

SEQ ID NO: 288 - protein, 409 aa, Vitis vinifera
MVKRSSPGSSSSPSSSSTSSDAASRPAPPSGGKPKSRKKEAKKNSNGNGSNSKNKRTSIYRGVTKHRWTGRFEAHLWDKSSWNDISNKRGRQGAYYNEEAAARTYDLAALKYWGPTTPLNFPLETYQKDAEEMEKMSKEEYLALLRRQSNGFSRGVSKHHHNGRWEARIGRVLGNKYLYLGTYSTQEEAAAAYDMAAIEYRGLNAVTNFDISNYVKLGRVEAQVQELAQQLQPNTPIGPQNELQKEEEEQLQEPVLSSSQHLPSMDSSAMEIMDPADDPDLPWNFCAYSTLLVPDVPLGKGGELSDLFYEKGFEDNIDYMFEGAAGNEEESNSAENGVKENGFMHELEVDGKLQNVVGFFFLSFFFLPKRAGIRKRGVDSCMQLFLYFVFLFYPFLPEVSKFLFHLSLD

SEQ ID NO: 289 - protein, 420 aa, Brachypodium distachyon
MKRSPPQPSPSPSSSPASSSSSPSSSDSSSSIAIPRKRARTAAAAAGGGKARAAAAKRPKKDGKDSGSSSNGGGGGGGKRSSIYRGVTRHRWTGRFEAHLWDKNCFTSLQNKKKGRQVYLGAYDTEEAAARAYDLAALKYWGPETTLNFSADDYGKERSEMEAVSREEYLAALRRRSSGFSRGVSKYRGVARHHHNGRWEARIGRVLGNKYLYLGTFDTQEEAARAYDLAAIQYRGANAVTNFDISRYLDQPQLLEQLQQQQGPQVVAALQEEAQRDHQSDNAVQELNSGEAQTPGGIDEPIAIGDSTEDINTSLTVDDIIEESLWSPYEFDIMAGVNVSNSMNLSELFSDVAFEGNIGCLFEECSGIDDCSSRHGAGLAAFGLFTEGDDKLKDVSEMEMEVNPQANDVSCPPKMITVCN

SEQ ID NO: 290 - protein, 423 aa, Hordeum vulgare
MKRSPPPQPSPSSSPACSPSPSSPSSSDSSSIAIPRKRARTQKAGSAKAKAAPKRAKKDSGRSTKDSDASANGAAASGKRSSIYRGVTRHRWTGRFEAHLWDKNCFTSIQNKKKGRQVYLGAYDTEEAAARAYDLAALKYWGPETTLNFTVDEYAKERSEMEAVSREEYLAALRRRSSGFSRGVSKYRGVARHHHNGRWEARIGRVLGNKYLYLGTFDTQEEAARAYDLAAIEYRGANAVTNFDISRYLDQPQLLAQLEQGPQVVPALQEELQHDHQSDNAVQELNSGEAQKPGSVSEPIAVDDTDNTGDIGAPLVFDSGVEENLWSPCMDYDVDPIFGPNISSSMNLSEWFNDPAFESNIGYMFEGCSDVDDCSTRHGAGLSALGFLKEGDDKLKDGSDMEAEITPQANDVSCPPKMITVCN

SEQ ID NO: 291 - protein, 443 aa, Oryza sativa
MAKRSSPDPASSSPSASSSPSSPSSSSSEDSSSPMSMPCKRRARPRTDKSTGKAKRPKKESKEVVDPSSNGGGGGKRSSIYRGVTRHRWTGRFEAHLWDKNCSTSLQNKKKGRQGAYDSEEAAARAYDLAALKYWGPETVLNFPLEEYEKERSEMEGVSREEYLASLRRRSSGFSRGVSKYRGVARHHHNGRWEARIGRVLGNKYLYLGTFDTQEEAAKAYDLAAIEYRGANAVTNFDISCYLDQPQLLAQLQQEPQLLAQLQQEPQVVPALHEEPQDDDRSENAVQELSSSEANTSSDNNEPLAADDSAECMNEPLPIVDGIEESLWSPCLDYELDTMPGAYFSNSMNFSEWFNDEAFEGGMEYLFEGCSSITEGGNSMDNSGVTEYNLFEECNMLEKDISDFLDKDISDFLDKDISISDGERISPQANNISCPQKMISVCN

SEQ ID NO: 292 - protein, 420 aa, Sorghum bicolor
MDMERSQQQKSPTESPPPPSPSSSSSSVSADTVLPPPGKRRRAATTAKAKAGAKPKRARKDAAAAADPPPPPAAAAAGKRSSVYRGVTRHRWTGRFEAHLWDKHCLAALHNKKKGRQVYLGAYDSEEAAARAYDLAALKYWGPETLLNFPVEDYSSEMPEMEGVSREEYLASLRRRSSGFSRGVSKYRGVARHHHNGRWEARIGRVFGNKYLYLGTFDTQEEAAKAYDLAAIEYRGVNAVTNFDISCYLDHPLFLAQLQQEPQVVPALNQEAQPDQSETETIAQESVSSEAKTPDDNAEPDDNAEPDDIAEPLITVDDSIEESLWSPCMDYELDTMSRSNFGSSINLSEWFNDADFDSNIGCLFDGCSAVDEGGKDGVGLADFSLLEDFSLFEAGDGQLKDVLSDMEEGIQPPTMISVCN

SEQ ID NO: 293 - protein, 395 aa, Zea mays
MERSQRQSPPPPSPSSSSSSVSADTVLVPPGKRRRAATAKAGAEPNKRIRKDPAAAAAGKRSSVYRGVTRHRWTGRFEAHLWDKHCLAALHNKKKGRQVYLGAYDSEEAAARAYDLAALKYWGPETLLNFPVEDYSSEMPEMEAVSREEYLASLRRRSSGFSRGVSKYRGVARHHHNGRWEARIGRVFGNKYLYLGTFDTQEEAAKAYDLAAIEYRGVNAVTNFDISCYLDHPLFLAQLQQEPQVVPALNQEPQPDQSETGTTEQEPESSEAKTPDGSAEPDENAVPDDTAEPLSTVDDSIEEGLWSPCMDYELDTMSRPNFGSSINLSEWFADADFDCNIGCLFDGCSAADEGSKDGVGLADFSLFEAGDVQLKDVLSDMEEGIQPPAMISVCN

SEQ ID NO: 294 - protein, 413 aa, Brachypodium distachyon
MEAYCSTLVKDELINGGGGGSAGGMRYCEAAPRVSPPVAIKSVKRRKREPPAVSGMTTVSGGGKDGDKSAGNAAAKRSSRFRGVSRHRWTGRFEAHLWDKGTWNPTQKKKGKQVYLGAYNEEEAAARAYDLAALKYWGPTTYTNFPVVDYEKELKVMQGVSREEYLASIRRKSNGFSRGVSKYRGVARHHHNGRWEARIGRVFGNKYLYLGTYSTQEEAARAYDIAAIEYRGINAVTNFDLSSYIRWLKPNSTINTNTPAAELAILGGGGTPAALITPPPTMHVPRLLPPLVKGRGSSIADDVSAGSCVFGGPSPSPSPTTTALSLLLRSSVFQELVAQQQPPSTVDDDDDIGGHAAVSDAAQRAAEENEESFGEVLYGAGEGEAATAFSCSMYELGLDDNFARIEESLWGCL

SEQ ID NO: 295 - protein, 423 aa, Brachypodium sylvaticum
MEAYCSSLVKDELINGGGGGAGGMRYCEAAPRVSPPVAIKSVKRRKREPPAVSGMTTVSGGGGGNGKDGDKSAGNAAAAKRSSRFRGVSRHRWTGRFEAHLWDKGTWNPTQKKKGKQVYLGAYNEEEAAARAYDLAALKYWGPTTYTNFPVVDYEKELKVMQGVSREEYLASIRRKSNGFSRGVSKYRGVARHHHNGRWEARIGRVFGNKYLYLGTYSTQEEAARAYDIAAIEYRGINAVTNFDLSSYIRWLKPNSAANTNTPPAAAAELAILGGAPAALISPAPAPTTMRVPRLLPPLVRGRGGSIPDDVSAGGSCVFGSPSPSPSPTTTSALSLLLRSSVFQELVAQQQPPSIVDDDDGVGGQEAVSDAAERAAEENEESFGEVLYGAGEGEAAAAFSCSMYELGLDDSFARIEESLWGCL

SEQ ID NO: 296 - protein, 399 aa, Oryza sativa
METYGLVKDELLHGIGGGQGRLYCEVKPTAAPAVITAAGGGAKSVKRRKREPSAAAMSAVTVAGNGKEAGGSNAANKRSSRFRGVSRHRWTGRFEAHLWDKGTWNPTQKKKGKQVYLGAYNEEDAAARAYDLAALKYWGPTTYTNFPVADYEKELKLMQGVSKEEYLASIRRKSNGFSRGVSKYRGVARHHHNGRWEARIGRVFGNKYLYLGTYSTQEEAARAYDIAAIEYRGINAVTNFDLSTYIRWLKPPSSSSAAGTPHHHGGGMVVGADRVLAPAQSYPISAAADDDVAGCWRPLPSPSSSTTTALSLLLRSSMFQELVARQPVVEGDDGQLAVVSGDDADADADSDVKEPPPESEYGEVFASDEAAAAAAYGCSMYELDDSFALIDDSVWNCLI

SEQ ID NO: 297 - protein, 488 aa, Sorghum bicolor
METYSLQVKDELHGGGIGIGGGGQGLYCGATPRPAAPAATGGGGGGGDGAVKSNKRSRKREPPPPPPSSLVTMSNGGKDEAVAGSGDKSASSNSNASKRSSRFRGVSRHRWTGRFEAHLWDKGTWNPTQKKKGKQVYLGAYNEEDAAARAYDLAALKYWGPTTYTNFPVVDYERELKVMQNVSKEEYLASIRRKSNGFSRGVSKYRGVARHHHNGRWEARIGRVFGNKYLYLGTYSTQEEAARAYDIAAIEYRGINAVTNFDLSTYIRWLKPGGGVEDSAAGTPTSGVRAPGIPPASLSLQAGGLLQHPHGAAAGMLQVDVDDLYRGQLAAARGAALFSGGIDDVGSVYAAGSAGPSPTALCAGRPSPSPSPSSSTTALSLLLRSSVFQELVARNAGGGAAQQQQLVVADDDGAVSPADVVDAKVEQPEAEGELGRHGDQLYGAARADEDEDAFACSMYELDDSFARMEQSLWGCLRSSDAPDNMNNL

SEQ ID NO: 298 - protein, 443 aa, Sorghum bicolor
MESSGMMMVKSEIESCGYPGPSSSTAPAAGVVIGGSATTERGEGGHHHHHHQVVVRRRRREPPLLAPIAGGGIGKPLPSITVKRSSRFRGVSRHRWTGRFEAHLWDKNSWNPTQRKKGKQVYLGAYDEEEAAARAYDLAALKYWGPTTYTNFPVMDYEKELKIMENLTKEEYLASLRRKSSGFSRGVSKYRGVARHHQNGRWEARIGRVFGNKYLYLGTYSTQEEAARAYDIAAIEYKGVNAVTNFDLRSYITWLKPSGAPAAFNPEAALLMQAAPAEQLLHPAETAQMLPRVGNPFLLDHGAAPPGSSGGGGQDASMSSMVSPGAGGGMRRRGSSTALSLLLKSSMFRQLVEKNSDAEEGVRDREDAAAAAAAAHPAGPGDAYEYHNFFQGEAPPDMCDLFSSGGGGDHARNAGFHGEIAACYDDGEGLDGWNGFGNMSSLQ

SEQ ID NO: 299 - protein, 407 aa, Glycine max
MELAPVKSELSPRSHRLLMIDGSEVIGTKCVKRRRRDSSTAVLGGNGQQGEQLEEQKQLGGQSTATTVKRSSRFRGVSRHRWTGRFEAHLWDKGTWNPTQKKKGKQVYLGAYNDEEAAARAYDLAALKYWGISTFTNFPVSDYEKEIEIMKTVTKEEYLASLRRRSSGFSRGVSKYRGVARHHHNGRWEARIGRVFGNKYLYLGTYSTQEEAARAYDIAAIEYRGINAVTNFDLSTYIRWLRPGTHPTASHDQKPSTDAQPFATSNSMQARGNIEVSNSNKNSFPSGKLDSTKKRDFSKYMNPLSPCNKPSSPTALGLLLKSSVFRELMQRNLNSSSEEAEEVELKYPHEGNDGVGGIYDNENTNNSYFCSSNISRLPNLESSEESPLPMYHGTVQSLWNSAFNMSN

SEQ ID NO: 300 - protein, 406 aa, Glycine max
MELAPVKSELSPRSHRLVIIDGSDVISTKCAKRRRRDSSMAVLGGNGQQGEQLEEQKQLGGQSTATTVKRSSRFRGVSRHRWTGRFEAHLWDKGTWNPTQKKKGKQVYLGAYNDEEAAARAYDLAALKYWGTSTFTNFPVSDYEKEIEIMKTVTKEEYLASLRRRSSGFSRGVSKYRGVARHHHNGRWEARIGRVFGNKYLYLGTYSTQEEAARAYDIAAIEYRGINAVTNFDLSTYIRWLRPGTHPTASHDQKPSTDAQLFATSNSMQTRGNIEVSNSNMHSFPSGELDSTKKRDFSKYMNPLSPCNKPSSPTALGLLLKSSVFRELMQRNLNSSSEEADVELKYPQEGNDGVGGIYDNDNTSNSYFCSSNISRLPNLESSEECPLPMYHGTMQSLWNSAFNMSN

SEQ ID NO: 301 - protein, 418 aa, Populus trichocarpa
MEMTRNTGDQISLGRRRLCMIEEERRAGEAGKCIKRRRRDPSTFALSCNINDQQSDQQQQQQSLGDRTAAVATTVKRSSRFRGVSRHRWTGRFEAHLWDKGTWNPTQRKKGKQGAYDEEESAARAYDLAALKYWGTSTFTNFPASDYEKEIEIMKTVTKEEYLASLRRRSSGFSRGVSKYRGVARHHHNGRWEARIGRVFGNKYLYLGTYSTQEEAAHAYDIAAIEYRGINAVTNFDLSTYIRWLKPEASLPAPQTQESKPASDPLPMATFSNHLPSEKPTQLSVLQMDPSLMDNLNTPKNEDIFHRKTLPVSPLTRSSSSTALSLLFKSSIFKELVEKNLNTTSEEIEENDSKNPHNGNNNAGEAFYDGLSPIPHTGTSTEDPFLCSEQGETNTLPPYSGMEQSLWNGALSMPSRFH

SEQ ID NO: 302 - protein, 336 aa, Vitis vinifera
MEMTTVKSELGLERGRLCTAETDALEVTKCVKRRRRDPSAVTPGCSKQGEQQKQVLLQAGQSITAIATTMKRSSRFRGVSRHRWTGRFEAHLWDKGSWNVTQRKKGKQVYLGAYDEEESAARAYDLAALKYWGPSTFTNFPVSDYEKEIEIMQGLTKEEYLASLRRRSSGFSRGVSKYRGVARHHHNGRWEARIGRVFGNKYLYLGTYSTQEEAAHAYDIAAIEYRGINAVTNFELSTYVRWLRPRATALTPQEPRSNSIMQASSNCLPNEEVELSFLSPNPFTVDDLATPLKQEKFQREVSISPCTKSSSPTALSLLHRSSVFRQLVEKNSNSIE

SEQ ID NO: 303 - protein, 389 aa, Glycine max
MAMMKENIIEVSLGRRQMSMTEGEFQGTRSVKRRRREVAAAAGSGDDNHQQQLPQQEVGENTTVNTTKRSSRFRGVSRHRWTGRYEAHLWDKLSWNITQKKKGKQGAYDEEESAARAYDLAALKYWGTSTFTNFPISDYEKEIQIMQTMTKEEYLATLRRKSSGFSRGVSKYRGVARHHHNGRWEARIGRVFGNKYLYLGTYSTQEEAARAYDIAAIEYRGIHAVTNFDLSTYIKWLKPSGGGTLEANLESHAALEHQKVASPSNYALTEESKSLALHNSFFSPYSLDSPVKHERFGNKTYQFSSNKSSSPTALGLLLRSSLFRELVEKNSNVSGEEDDGEATKDQQTQIATDDDLGGIFFDSFSDIPFVCDPNRYDLELQERDLHSIF

SEQ ID NO: 304 - protein, 389 aa, Glycine max
MVMMKENIIEEKLGRSQMSMVEGEFQGTWGVKRRRREVAAAASSGDDNHHQQLPQQEVGENSSISTTKRSSRFRGVSRHRWTGRYEAHLWDKLSWNITQKKKGKQGAYDEEESAARAYDLAALKYWGNSTFTNFPISDYEKEIEIMQTMTKEEYLATLRRKSSGFSRGVSKYRGVARHHHNGRWEARIGRVFGNKYLYLGTYSTQEEAARAYDIAAIEYRGIHAVTNFDLSTYIKWLKPSGGGTPEENLESHAVLEHQKLASPSNYALTEESKSLVLPNSFISPDSLDSPVKHESFGNKTYQFSRNKSSSPTALGLLLRSSLFRELVEKNSNVSGEEADGEVTKDQQPQLASDDDLDGIFFDSFGDIPFVCDPTRYNLELQERDLHSIF

SEQ ID NO: 305 - protein, 392 aa, Medicago truncatula
MAMLIENEVMCLGKSQRSMDGKEVKGARRVKRQRRDAIVPKIGDDANKMAQKQVGENSTTNTSKRSSRFRGVSRHRWTGRFEAHLWDKLSWNTTQKKKGKQGAYDEEESAARAYDLAALKYWGTSTFTNFPISDYDKEIEIMNTMTKEEYLATLRRKSSGFSRGVSKYRGVARHHHNGRWEARIGRVFGNKYLYLGTYSTQEEAARAYDIAAIEYRGIHAVTNFELSSYIKWLKPETTTEENHESQILQKESRTLAPPNNSTLLQESKLLALQKSFFIPNDLNSTEKQESSFENKNYHFLSNKSTSPTALSLLLRSSLFRELLEKNSNVSEDEVTKEQQQQQITSDDELGGIFYDGIDNISFDFDPNSCNIELQERDLHSISCLYQYLNFGQ

SEQ ID NO: 306 - protein, 386 aa, Populus trichocarpa
MMMIKNEENPGRRRGCIADSEAQVARCVKRRRRDPAIVALGSDDNQSQQQMPQKQTDQTSAATTVKRSSRFRGVSRHRWTGRFEAHLWDKLSWNVTQKKKGKQGAYDEEESAARAYDLAALKYWGTSTFTNFPISDYEKEIEIMQTVTKEEYLASLRRKSSGFSRGVSKYRGVARHHHNGRWEARIGRVFGNKYLYLGTYSTQEEAARAYDIAAIEYRGINAVTNFDLSTYIRWIKPGVAAQAAANELQTVTDPQTAATLTDTYTPREETKPSLFLPNQFTADYLNSPPKLDAFQNNIFVDSSNKTSSPTALSLLLRSSVFRELVEKNSNVCEEETDGNEIKNQPMAGSDDEYGGIFYDGIGDIPFVYSSNKYSLGLEERELQFVL

SEQ ID NO: 307 - protein, 372 aa, Ricinus communis
MEMMMVKNEEISGRRRASVTESEAYVARCVKRRRRDAAVVTVGGDDSQSHQQQQQQQPEQQAHQISAATTVKRSSRYRGVSRHRWTGRFEAHLWDKLSWNVTQKKKGKQGAYDEEESAARAYDLAALKYWGTSTFTNFPISDYEKEIEIMQTVTKEEYLASLRRKSSGFSRGVSKYRGVARHHHNGRWEARIGRVFGNKYLYLGTYSTQEEAARAYDIAAIEYRGINAVTNFDLSTYIRWLKPEVAAQVAANEPQTVAESRMLPSINNRIAREESKPSFFSATPFSLDCWSYPRKQEEFQNRTPITPCSKTSSPTALSLLLRSSIFRELVEKNSNVSEDENEGEETKNQSQIGSDDEFGGLFYERIGDIPFI

SEQ ID NO: 308 - protein, 404 aa, Vitis vinifera
MEMMRVKSEENLGRRRMCVADAEAQGTRCVKRRRRDPAIVTLGCDDQSQQQQLPNQQPDQASAATTVKRSSRFRGVSRHRWTGRFEAHLWDKFSWNVTQKKKGKQGAYDEEESAARAYDLAALKYWGASTFTNFPVSDYEKEIEIMQSVTKEEYLACLRRKSSGFSRGVSKYRGVARHHHNGRWEARIGRVFGNKYLYLGTYSTQEEAARAYDIAAIEYRGINAVTNFDLSTYIRWLNPAANNPVVPHESRANTEPQALASSNFVLSEESEPLFFHSNSFTMDDLNPPHKQEVFQTKIPIEPCSKSSSPTALGLLLRSSIFRELVEKNSNAPEDETDAEDTKNQQQVGSDDEYGIFYDGIGDIPFVCPSNGDRNELQERLPLPFTISQGNPYGTAVLTSMQSIN

SEQ ID NO: 309 - protein, 378 aa, Brachypodium distachyon
MAKQRTDSAGTDAAAVQLTKPKRTRKSVPRRESPSRRTSAYRGVTRHRWTGRFEAHLWDKNTWTQSQRKKKGRQVYLGAYGGEEAAARAYDLAALKYWGRDTVLNFPLSNYDEEWKEMEGQSREEYIGSLRRKSTGFSRGVSKYRGVARHHHNGKWEARIGRVYGNKYLYLGTYGTQEEAAMAYDIAAIEHRGLNAVTNFDVSRYIDWHRRLCRDLGDNIITPLTNPTVDLEEAMAGDDDDGQFLLPSQATTPPSTSSALGLLLLSPRLKEVIEGSGAASAMAASTSESSAAGSPPPSWSSSSCSPSPPSPSHSPPETQQKQQQQEYGASAAAARCSFPDDVQTYFGCEDGCAEVDTFLFGDLSAYAAPMFQFELLDV

SEQ ID NO: 310 - protein, 416 aa, Oryza sativa
MAKRRSNGETAAASSDDSSSGVCGGGGGGEVEPRRRQKRPRRSAPRDCPSQRSSAFRGVTRHRWTGRFEAHLWDKNTWNESQSKKGRQGAYDGEEAAARAYDLAALKYWGHDTVLNFPLSTYDEELKEMEGQSREEYIGSLRRKSSGFSRGVSKYRGVARHHHNGKWEARIGRVFGNKYLYLGTYATQEEAAVAYDIAAIEHRGLNAVTNFDINLYIRWYHGSCRSSSAAAATTIEDDDFAEAIAAALQGVDEQPSSSPATTRQLQTADDDDDDLVAQLPPQLRPLARAASTSPIGLLLRSPKFKEIIEQAAAAAASSSGSSSSSSTDSPSSSSSSSLSPSPLPSPPPQQQPTVPKDDQYNVDMSSVAAARCSFPDDVQTYFGLDDDGFGYPEVDTFLFGDLGAYAAPMFQFELDV

SEQ ID NO: 311 - protein, 440 aa, Sorghum bicolor
MARPRKNAGTDEDNPNAATGVSVTGKPPKLKRVRRKGEPRESSTPSQRSSAYRGVTRHRWTGRFEAHLWDKDARNGSRNKKGKQGAYDDEEAAARAHDLAALKYWGPATVLNFPLCGYDEELREMEAQPREEYIGSLRRRSSGFSRGVSKYRGVARHHHNGRWEARIGRVLGNKYLYLGTFATQEEAAVAYDIAAIEHRGLNAVTNFDISHYVNHWHRHCHGPSDDSLGVVVDDVAAFQLPDDLPECPAAAIGVEETTGGDAEFHNGEEGYLQHHTSGPFGAQQQLPDETGALAAHQMAPNSSALDMVLQSPKFKELMEQVSAAAAAVASESSIGGSMSSSSPSPSLSSFSPSPLQLPSPSSLSSFSPSSPLQQPSPPLQQPEFVEGAPAARCSFPDDVQTFFDFENESDMSFMYAEVDTFLFGDLGAYAAPIFHFDLDV

SEQ ID NO: 312 - protein, 408 aa, Zea mays
MARPRKNGGTDEDDANAATGATGKPKKLMKRARRKSESPSPRSSAYRGVTRHRWTGRFEAHLWDKDARNGSRSKKGKQVYLGAYDDEDAAARAHDLAALKYWGPAGTVLNFPLSGYDEERREMEGQPREEYVASLRRRSSGFARGVSKYRGVARHHHNGRWEARIGRVLGNKYLYLGTYATQEEAAVAYDMAAIEHRGFNAVTNFDISHYINHWHRHCHGPCDGSLGAMDVAPNVSLELDLLECPATVGLGLEETTGDDEFHNREDYLGHLFGVQQLPDEMGPPAHQMAPASSALDLVLQSPRFKELMQQVSAAGASETNGGSMRSSPSTSLCSFSPSPLELPSPPLQQPTEFIDGAPPRCSFPDDVQSFFDFKNDNDMSFVYAEVDTFLFGDLGAYAPPMFDFDLYE

SEQ ID NO: 313 - protein, 304 aa, Arabidopsis lyrata
MAKVSRRSKKTIVEDEISDKTASASEAASIVFKSKRKRKSPPRNAPPQRSSPYRGVTRHRWTGRYEAHLWDKNSWNETQTKKGRQVYIGAYDEEEAAARAYDLAALKYWGRDTLLNFPLLIYDEDVKEMEGQSKEEYIGSLRRKSSGFSRGVSKYRGVARHHHNGRWEARIGRVFGNKYLYLGTYATQEEAAIAYDIAAIEYRGLNAVTNFDVSRYLNPDAADSKPIRNDPESSDDNKCPKSEEIIEPSTSPEAITTRRSFPDDIQTYFGCQDSGKLATEEDVIFGGLNSFINPGFYNEFDYGP

SEQ ID NO: 314 - protein, 308 aa, Arabidopsis thaliana
MAKVSGRSKKTIVDDEISDKTASASESASIALTSKRKRKSPPRNAPLQRSSPYRGVTRWTGRYEAHLWDKNSWNDTQTKKGRQGAYDEEEAAARAYDLAALKYWGRDTLLNFPLPSYDEDVKEMEGQSKEEYIGSLRRKSSGFSRGVSKYRGVARHHHNGRWEARIGRVFGNKYLYLGTYATQEEAAIAYDIAAIEYRGLNAVTNFDVSRYLNPNAAADKADSDSKPIRSPSREPESSDDNKSPKSEEVIEPSTSPEVIPTRRSFPDDIQTYFGCQDSGKLATEEDVIFDCFNSYINPGFYNEFDYGP

SEQ ID NO: 315 - protein, 303 aa, Arabidopsis thaliana
MAKVSGRSKKTIVDDEISDKTASASESASIALTSKRKRKSPPRNAPLQRSSPYRGVTRHRWTGRYEAHLWDKNSWNDTQTKKGRQVYLGAYDEEEAAARAYDLAALKYWGRDTLLNFPLPSYDEDVKEMEGQSKEEYIGSLRRKSSGFSRGVSKYRGVARHHHNGRWEARIGRVFATQEEAAIAYDIAAIEYRGLNAVTNFDVSRYLNPNAAADKADSDSKPIRSPSREPESSDDNKSPKSEEVIEPSTSPEVIPTRRSFPDDIQTYFGCQDSGKLATEEDVIFDCFNSYINPGFYNEFDYGP

SEQ ID NO: 316 - protein, 332 aa, Arabidopsis lyrata
MEEITRKSKKTSVENETGDDQSATSVVVKAKRKRRSQPRDAPPQRSSVHRGVTRHRWTGRYEAHLWDKNSWNETQSKKGRQGAYDEEDAAARAYDLAALKYWGRDTILNFPLCNYEEDIKEMESQSKEEYIGSLRRKSSGFSRGVSKYRGVAKHHHNGRWEARIGRVFGNKYLYLGTYATQEEAAIAYDIAAIEYRGLNAVTNFDISRYMKLPVPENPIDAANNLLESPHSDSSPFINPTHESDLSQSQSSSDDNDDRKTKLLKSSPLNAEEVIGPSTPPEIAPPRRSFPEDIQTYFGCQNSGKLTTEEDDVIFGDLDSFLTPDFYSELNDC

SEQ ID NO: 317 - protein, 328 aa, Thellungiella halophila
MAKVSQRSKKTIVNDEISDKKAVAVASVSSSAFLKSKRKRKLPPQNAPPQRSSSYRGVTRHRWTGRYEAHLWDKNCWNETQTKKGRQVYLGAYDEEEAAARAYDLAALKYWGRDTLLNFPLPTYEEDVKEMEGHSREEYIGSLRRKSSGFSRGVSKYRGVARHHHNGRWEARIGRVFGNKYLYLGTYATQEEAARAYDIAAIEYRGLNAVTNFDVSRYLNLPESKNPSAAANHLPDESDYYDSMPVRNPNHEPRSPDGQTSSEDNDYTKTEETLDPEAIPSRRSFPDDIQTYFGCQDSGKLATEEDVIFGGFNSFINPGFYNDFDYAP

SEQ ID NO: 318 - protein, 345 aa, Arabidopsis thaliana
MFIAVEVSPVMEDITRQSKKTSVENETGDDQSATSVVLKAKRKRRSQPRDAPPQRSSVHRGVTRHRWTGRYEAHLWDKNSWNETQTKKGRQVYLGAYDEEDAAARAYDLAALKYWGRDTILNFPLCNYEEDIKEMESQSKEEYIGSLRRKSSGFSRGVSKYRGVAKHHHNGRWEARIGRVFGNKYLYLGTYATQEEAAIAYDIAAIEYRGLNAVTNFDISRYLKLPVPENPIDTANNLLESPHSDLSPFIKPNHESDLSQSQSSSEDNDDRKTKLLKSSPLVAEEVIGPSTPPEIAPPRRSFPEDIQTYFGCQNSGKLTAEEDDVIFGDLDSFLTPDFYSELNDC

SEQ ID NO: 319 - protein, 299 aa, Glycine max
MAKKSQKSLKNNNNNNTTRKRTRKSVPRDSPPQRSSIYRGVTRHRWTGRYEAHLWDKNCWNESQSKKGRQVYLGAYDDEEAAARAYDLAALKYWGQDTILNFPLSNYEEKLKEMEGQSKEEYIGSLRRKSSGFSRGVSKYRGVARHHHNGRWEARIGRVFGNKYLYLGTYATQEEAAAAYDMAAIEYRGLNAVTNFDLSRYINWPRPKTEENHQNTPSNQNVNSNAELELGSASDEITEEGVARSSESESNPSRRTFPEDIQTIFENNQDSGIYIENDDIIFGDLGSFGAPIFHFELDV

SEQ ID NO: 320 - protein, 393 aa, Brachypodium distachyon
MAKPRKNSAAANNNNNDNSTNANNAVAEAAAADVRAKPKKRTRKSVPRESPSQRSSIYRGVTRHRWTGRFEAHLWDKNSWNESQNKKGKQVYLGAYDEEEAAARAYDLAALKYWGPDTILNFPLSVYDDELKEMEGQSREEYIGSLRRKSSGFSRGVSKYRGVARHHHNGRWEARIGRVFGNKYLYLGTYATQEEAAMAYDMAAIEYRGLNAVTNFDLSRYIKWLRPGGGVDSAAAAAARNPHPMLAGLATQEELPAIDHLLDGMAFQQHGLHSSSAAAAAAQEFPLPPALGHAPTTSALSLLLQSPKFKEMIERTSAAETTTTATTTSSSSSPRPAASPQCSFPEDIQTFFGCDDGVGVGVGAVGYTDVDGLFFGDLSAYASSTAFHFELDL

SEQ ID NO: 321 - protein, 379 aa, Oryza sativa
MAKPRKNSTTTNTSSSGVAAAAAAAAVKPKRTRKSVPRESPSQRSSVYRGVTRHRWTGRFEAHLWDKNSWNESQNKKGKQVYLGAYDDEEAAARAYDLAALKYWGPDTILNFPLSAYEGELKEMEGQSREEYIGSLRRKSSGFSRGVSKYRGVARHHHNGRWEARIGRVFGNKYLYLGTYATQEEAAMAYDMAAIEYRGLNAVTNFDLSRYIKWLRPGADGAGAAQNPHPMLGALSAQDLPAIDLDAMASSFQHDGHGAAAAAAQLIPARHSLGHTPTTSALSLLLQSPKFKEMIERTSAAETTTTSSTTTSSSSPSPPQATKDDGASPQCSFPKDIQTYFGCAAEDGAAGAGYADVDGLFFGDLTAYASPAFHFELDL

SEQ ID NO: 322 - protein, 398 aa, Sorghum bicolor
MAKPRKNSAAANNNNSSSNGAGDLTPRAKPKRTRKSVPRESPTQRSSVYRGVTRHRWTGRFEAHLWDKNSWNESQNKKGKQVYLGAYDDEEAAARAYDLAALKYWGPDTILNFPASAYEGEMKGMEGQSREEYIGSLRRKSSGFSRGVSKYRGVARHHHNGRWEARIGRVFGNKYLYLGTYATQEEAAMAYDMAAIEYRGLNAVTNFDLSRYIKWLRPGAGGMAAAAAAAQNPHPMLGGLAQQLLLPPPADTTTTDGAGAAAFQHDHHGAEAFPLPPRTSLGHTPTTSALSLLLQSPKFKEMIQRTESGTTTTTTTTSSLSSSPPPTPSPSPPRRSPAPTQPPVQAAARDASPHQRGFPEDVQTFFGCEDTAGIDVEALFFGDLAAYATPAFHFEMDL

SEQ ID NO: 323 - protein, 396 aa, Zea mays
MARPRKNSAAAANNNNSNTTNAGNAAVDLAARVKPKRTRKSVPRESPSQRSSVYRGVTRHRWTGRFEAHLWDKNSWNESQNKKGKQVYLGAYDDEDAAARAYDLAALKYWGPDTILNFPASAYEAELKEMEGQSREEYIGSLRRKSSGFSRGVSKYRGVARHHHNGRWEARIGRVFGNKYLYLGTYGTQEEAAMAYDMAAIEYRGLNAVTNFDLSRYIKWLRPGAGAAQNPHPMLDGLAQQLLLSPEGTIDGAAFHQQQHDHRQQGAAELPLPPRASLGHTPTTSALGLLLQSSKFKEMIQRASAAESGTTTVTTTSSSSSQPPTPTPTPSPSPPPTPPVQPARDASPQCSFPEDIQTFFGCEDVAGVGAGVDVDALFFGDLAAYASPAFHFEMDL

SEQ ID NO: 324 - protein, 362 aa, Glycine max
MAKKSQLRTQKNNATNDDINLNATNTVITKVKRTRRSVPRDSPPQRSSIYRGVTRHRWTGRYEAHLWDKHCWNESQNKKGRQGAYDNEEAAAHAYDLAALKYWGQDTILNFPLSNYLNELKEMEGQSREEYIGSLRRKSSGFSRGISKYRGVARHHHNGRWEARIGKVFGNKYLYLGTYATQEEAATAYDLAAIEYRGLNAVTNFDLSRYIKWLKPNNTNSNNDQISINLTNINNNCTNNFIPNPDQEQEVSFFHNQDSLNNTIVEEATLVPHQPRPASATLALELLLQSSKFKEMVEMTSVANLSTQMESDQLPQCTFPDHIQTYFEYEDSNKYEEGDDLLFKFSEFSSIVPFYHCDEFES

SEQ ID NO: 325 - protein, 370 aa, Glycine max
MAKKSQLRTQKNNVTTNDDNNLNVTNTVTTKVKRTRRSVPRDSPPQRSSIYRGVTRHRWTGRYEAHLWDKHCWNESQNKKGRQVYLGAYDNEEAAAHAYDLAALKYWGQDTILNFPLSNYLNELKEMEGQSREEYIGSLRRKSSGFSRGISKYRGVARHHHNGRWEARIGKVFGNKYLYLGTYATQEEAATAYDLAAIEYRGLNAVTNFDLSRYIKWLKPNNNTNNVIDDQISINLTNINNNNNCTNSFTPSPDQEQEASFFHNKDSLNNTIVEEVTLVPHQPRPASATSALELLLQSSKFKEMMEMTSVANLSSTQMESELPQCTFPDHIQTYFEYEDSNRYEEGDDLMFKFNEFSSIVPFYQCDEFES

SEQ ID NO: 326 - protein, 356 aa, Medicago truncatula
MAKKSQKQIEKDDNASNDNDNLNPSNTVTTKAKRTRKSVPRTSPPQRSSIYRGVTRHRWTGRYEAHLWDKNCWNESQNKKGRQGAYDNEETAAHAYDLAALKYWGQDTIINFPLSNYQKELIEMESQSREEYIGSLRRKSSGFSRGVSKYRGVARHHHNGRWEARIGKVFGNKYLYLGTYATQEEAATAYDMAAIEYRGLNAVTNFDLSRYIKWLKPNNNNNDDNNKSNINLCDINSNSSANDSNSNEELEFSLVDNEISLNNSIDEATLVQPRPTSATSALELLLQSSKFKEMVEMASMTSNVSTTLESDQLSQCAFPDDIQTYFEYENFNDTMLEDLNSIMPTFHYDFEGAEVL

SEQ ID NO: 327 - protein, 347 aa, Glycine max
MAKQQTHKINASTNNNISTTNTVTAKVKRTRRSVPRDSPPQRSSIYRGVTRHRWTGRYEAHLWDKNCWNESQNKKGRQGAYDDEEAAAHAYDLAALKYWGQDTILNFPLSTYQNELKEMEGQSREEYIGSLRRKSSGFSRGVSKYRGVARHHHNGRWEARIGRVFGNKYLYLGTYATQEEAATAYDMAAIEYRGVNAVTNFDLSRYIKWLKPNNNNTTVNSNLIDSNPNCETNFTSNSNQQQGFNFFNRQESFNNEEAAMTQPRPAVATSALGLLLQSSKFKEMMEMTSATDLSTPPSESELPSCTFPDDIQTYFECEDSHRYGEGDDIMFSVLNGFVPPMFHCDDF

SEQ ID NO: 328 - protein, 351 aa, Glycine max
MAKQQTHEINASTNNNINTTKTVTTKVKRTRRSVPRNSPPQRSSIYRGVTRHRWTGRYEAHLWDKNCWNESQNKKGRQGAYDDEEAAAHAYDLAALKYWGQDTILNFPLSTYQNELKEMEGQSREEYIGSLRRKSSGFSRGVSKYRGVARHHHNGRWEARIGRVFGNKYLYLGTYATQEEAATAYDMAAIEYRGLNAVTNFDLSRYIKWLKPNNNNNKVNSNNLIVSIPNCATNFTPNSNQQQGFNFFNSQESFNNNEEAAMTQPRPAAATSALGLLLQSSKFKEMMEMTSAIDLSTPPSESELPPCTFPDDIQTYFECEDSHRYGEGDDIMFSELNGFVPPMFHCDDFEA

SEQ ID NO: 329 - protein, 353 aa, Populus trichocarpa
MAKLSQKNTKNTASNNNNTTNGVTKVKRTRRSVPRDSPPQRSSIYRGVTRHRWTGRYEAHLWDKNCWNESQNKKGRQGAYDDEEAAAHAYDLAALKYWGPETILNFPLSTYQNELKEMEGQSREECIGSLRRKSSGFSRGVSKYRGVARHHHNGRWEARIGRVFGNKYLYLGTYATQEEAATAYDMAAIEYRGLNAVTNFDLSRYIKWLKPNQNNTDNNNGLDLPNPIIGTDNSTHPNPNQELGTTFLQINQQTYQPSETTLTQPRPATNPSSALGLLLQSSKFKEMMEMTAVTDCPPTPPSGLDPTPCSFLEDVQTYFDCLDSSNYGDQGDDMIFGDLNSFVPPMFQCDFET

SEQ ID NO: 330 - protein, 323 aa, Vitis vinifera
MAKLSQQNHKNSANSNATNTTLSVTKVKRTRKTVPRDSPPQRSSIYRGVTRHRWTGRYEAHLWDKNCWNESQNKKGRQVYLGAYHDEEAAAHAYDLAALKYWGPETILNFPLSTYEKELKEMEGLSREEYIGSLRRRSSGFSRGVSKYRGVARHHHNGRWEARIGRVFGNKYLYLGTYATQEEAATAYDMAAIEYRGLNAVTNFDLSRYIKWLKPNQNNPCEQPNNPNLDSNLTPNPNHDFGISFLNHPQTSGTAACKMMEMTTAADHLSTPPESELPRCSFPDDIQTYFECQDSGSYEEGDDVIFSELNSFIPPMFQCDFSA

SEQ ID NO: 331 - protein, 347 aa, Vitis vinifera
MAKLSQQNHKNSANSNATNTTLSVTKVKRTRKTVPRDSPPQRSSIYRGVTRHRWTGRYEAHLWDKNCWNESQNKKGRQGAYHDEEAAAHAYDLAALKYWGPETILNFPLSTYEKELKEMEGLSREEYIGSLRRRSSGFSRGVSKYRGVARHHHNGRWEARIGRVFGNKYLYLGTYATQEEAATAYDMAAIEYRGLNAVTNFDLSRYIKWLKPNQNNPCEQPNNPNLDSNLTPNPNHDFGISFLNHPQTSGTAACSEPPLTQTRPPIASSALGLLLQSSKFKEMMEMTTAADHLSTPPESELPRCSFPDDIQTYFECQDSGSYEEGDDVIFSELNSFIPPMFQCDFSA

SEQ ID NO: 332 - protein, 275 aa, Populus trichocarpa
MGKTSKQSLKNSANTSINPATKVKRTRKSVPRDSPPQRSSIYRGVTRHRWTGRYEAHLWDKNCWNESQNKKGRQGAYDDEEAAGHAYDLAALKYWGQDTILNFPLSTYEEEFKEMEGHSKEEYIGSLRRKSSGFSRGVSKYRGVARHHHNGRWEARIGRVFGNKYLYLGTYATQEEAATAYDMAAIEYRGLNAVTNFDLSRYSSKFKEMLERTSASDCPLTPPESDRDPPRRSFPDDIQTYFDCQDSSSYTDGDDIIFGDLHSFASPIFHCELDG

SEQ ID NO: 333 - protein, 304 aa, Vitis vinifera
MAKTSQKSQKTTGNSTNNNGGSVAKVKRTRKSVPRDSPPQRSSIFRGVTRHRWTGRYEAHLWDKNCWNESQNKKGRQVYLGAYDDEEAAAHAYDLAALKYWGQETILNFPLSAYQEELKEMEGQSKEEYIGSLRRKSSGFSRGVSKYRGVARHHHNGRWEARIGRVFGNKYLYLGTYATQEEAATAYDMAAIEYRGLNAVTNFDLSRYINSPAPNPNPSDHELGLSFLQQQHGSDATELPLSHARSDCPLTPPDQIEMPRSSFPDDIQTYFDCQETNSYGESDDIIFGDLKYFSSPMFQCELDT

SEQ ID NO: 334 - protein, 393 aa, Sorghum bicolor
MASPNPEAAAGLQTVAVAAGGGEGGSSSSLGAVAGAAAVSSSGELVPRRSLAVRKERVCTAKERISRMPPCAAGKRSSIYRGVTRHRWTGRYEAHLWDKSTWNQNQNKKGKQGAYDDEEAAARAYDLAALKYWGAGTQINFPVSDYARDLEEMQMISKEDYLVSLRRQLHNSRWDTSLGLGNDYMSLSCGKDIMLDGKFAGSFGLERKIDLTNYIRWWLPKKTRQSDTSKTEEIADEIRAIESSMQQTEPYKLPSLGLGSPSKPSSVGLSACSILSQSDAFKSFLEKSTKLSEECTLSKEIVEGKTVASVPATGYDTGAININMNELLVQRSTYSMAPVMPTPMKTTWSPADPSVDPLFWSNFVLPSSQPVTMATITTTTNEVSSSDPFQSQE

SEQ ID NO: 335 - protein, 428 aa, Lupinus angustifolius
MASSSSDPGKSEIGGGAAETSEAAAVAVAVTNDQSLLYRGLKKAKKERGCTAKERISKMPPCAAGKRSSIYRGVTRHRWTGRYEAHLRDKSTWNQNQNKKGKQVYLGAYDDEEAAARAYDLAALKYWGPGTLINFPVTDYTRDLEEMQNVSREEYLASLRRKSSGFSRGISKYRALSSRWEPSYSRFAGSDYFNSMHYGAGDDSAAESEYASGFCIERKIDLTGHIKWWGSNKSRQPDAGTRLSEEKRHGFAGDICSEPKTLEQKVQPTEPYQMPELGRSHNEKKHRSSAVSALSILSQSAAYKSLQEKASKKQENSTDNDENENKNTVNKLDHGKAVEKSSNHDGGSDRVDIEIGTTGALSLQRNIYPLTPFLSAPLLTAYNTVDPSLVDPVLWTSLVPMLSAGLSCPTQVTKTETSSSYTIFQPEG

SEQ ID NO: 336 - protein, 440 aa, Ricinus communis
MASSSSDPGLKPELGGGSGGESSEAVIANDQLLLYRQLKKPKKERGCTAKERISKMPPCTAGKRSSIYRGVTRHRWTGRYEAHLWDKSTWNQNQNKKGKQGAYDDEEAAARAYDLAALKYWGPGTLINFPVTDYSRDLEEMQNVSREEYLASLRRKSSGFSRGISKYRGLSSQWDSSFGRMPGSEYFSSINYGAADDPAAESEYVGSLCFERKIDLTSYIRWWGFNKTRESVSKSSDERKHGYGEDISELKSSEWAVQSTEPYQMPRLGMPDNGKKHKCSKISALSILSHSAAYKNLQEKASKKQENCTDNDEKENKKTNKMDYGKAVEKSTSHDGSNERLGAALGMSGGLSLQRNAYQLAPFLSAPLLTNYNAIDPLVDPILWTSLVPVLPAGFSRNSEVGMGLQIVSCHKDRDKFNLYLLSAGGVSTFLLLVVHWRFC

SEQ ID NO: 337 - protein, 428 aa, Lupinus angustifolius; identical to SEQ ID NO: 335

SEQ ID NO: 338 - DNA, 1527 bp, Aspergillus fumigatus
atgaagatgagtgcttccaaaacagtaacttcgtcagccagtgccgttagcacgagctctggaaggtcgactccgtcgaagctcgtcaatggagctacccgcaatggctccgcagcagctggcaacggctctaccgggacagccaaagggaagaggaggagcaaatatcgccatgttgcagcttatcattcagagctgcggcattcgagcctcagtagagagaccagtgtggtcccaagctttcttggattccggaatctcatggtgattgttttagtggcgatgaatcttcgcctgataattgaaaatttcatgaaatatggcgtccttatctgcatcaaatgtcatgactatcggaagcaggatgtagttcttgggtcgattctctttgcccttgttccatgccatctcttccttgcgtacatcattgaattggttgcagctcagcaatccaagaaaactgtcggtcgacagaaaaaggatctatcgacggaggagagggagcgcgaacaacaggccttccgctcaacctggaggtatacagccttcttccataccgtgaacgctaccctttgcctcgccgtgaccagcttcgttgtttatttctacatcaatcatcctggaatcggtacaatttgtgagctccacgcaatcattgtgtggctcaaaaattgctcctatgcatttacgaatcgcgatctgcggcaggcaatggtcgacccctctgcagagtctgctctcccagaaatctactccacatgcccatatccaagaaatatcacacttgggaaccttacatatttttggctagcaccgacacttgtatatcaacccgtttatcctcgatcgtcgcatattcgatggtcttttgttgccaaacggcttgctgagttttttggtttagctgtcttcatatggcttctctcggctcagtatgcagccccggtcttgcgaaattccattgacaagatagctgtgatggatattgcgtcaatcctcgagcgggtcatgaaactctccacaatttcgcttgtcatttggctcgctggattctttgcgctcttccagtcgctgctgaatgctttggcggaggtcatgcggttcggagatcgtgagttctacacagattggtggaacagcccgagtctcggcgcatactggcggtcatggaacaggccggtgtacctcttcatgaagaggcatgttttctcgccgctggtaggaagaggctggagcccttttgcggcgagcttcatggtcttttccctctctgcagtcctgcatgagatgttggtggggattcctacccacaatttgatcggtgttgcatttgcggggatgatgttccagctgccattgattgctgtgacagctccctttgaaaaggtgaatgacgccttgggcaagattgtagggaactcaatcttctgggtaagcttttgcctcgttggtcaaccgctgggtgcgctcttgtatttctttgcatggcaggcgaagtacggaagtgtcagcaagatacacgtttag

SEQ ID NO: 339 - DNA, 2067 bp, Ricinus communis
ggacactgacatggactgaaggagtagaaacttcttcttctgctgctgttcctctctcctccaccgccacgctcacctctctttgcatgacataatactattgttcttattatcattttcactctttaaatacaaacatcaattattccttttctatcaaacacatgtattctattctctcgtcgtctagattctcatcttcattgaatcctccttcttagcgtgtctttgtccacttcttttgggcaccgacgtttttaatctccatgacgattctcgaaacgccagaaactcttggcgtcatctcctcctccgccacttccgatctcaacctctctctccgacgtagacggacctcaaatgactccgatggtgcacttgctgatttggcttcgaagtttgatgatgatgacgacgtaagatcggaagattctgctgaaaatattatcgaagatcctgtagcagcggttactgaattggcgacagcaaagagtaacggaaaagactgtgttgccaatagtaataaggataaaattgatagccatggaggatcatcggattttaaacttgcatataggccttcggttccagctcaccggtcacttaaggagagtccgcttagctctgatttaatatttaaacaaagtcatgcaggtctgtttaacctttgtatagtagtgctcgtagctgttaacagcaggctcatcattgagaatttaatgaagtatggctggttaattaagacgggcttttggtttagttcaagatcattgagagattggccgctttttatgtgctgtctttctctcccagtattcccccttgctgcctatctagttgagaaggccgcatatcgaaaatatatatctccgcctattgttattttccttcatgtgatcatcacctcagcagctgttttgtacccagcttctgtaattctcagttgtgaatctgcttttttatctggtgtcacattgatggaacttgcttgtatggtatggttgaaattggtatcctatgcacatacaaactatgatatgagagcgatcgctgacaccattcataaggaagatgcatccaattcttctagtacagagtattgtcatgatgtgagctttaagactttggcgtacttcatggtcgcacccacattatgttaccagccaagttatcctcgcacagcatttattagaaagggctgggtgttccgtcaatttgtcaaactaataatttttacaggattcatgggatttatcatagaacaatacatcaatcctatcgtccagaattctcaacaccctttaaaaggggatctcttatatgccattgagagggttctgaagctctcagttccgaatttatatgtgtggctctgcttgttctactgcttttttcacctgtggttgaatatagttgctgagctccttcgcttcggtgaccgggagttctacaaagattggtggaatgcaaaaactgttgaggagtactggaggatgtggaatatgcctgttcacaagtggatggttcgccatatctacttcccatgcctacgtcgtaaaataccaaggggggtagcaatagttattgctttcttcgtttcagctgtatttcatgagttgtgcattgctgttccttgccacatgttcaaactttgggctttttttggaataatgtttcagattcctttagttgtgatcactaattattttcaaaggaagttcagaagctcaatggtgggaaatatgatcttctggttctttttctgcattctcggccaacctatgtgtgtactgttgtattaccatgacctaatgaatcgcgatgggaactgaaccatgggctcagtccagatatgggtacaccttccaagatgttattttcgtgagtgaagactgcaccacagtgttgttcttgttacacaatccccattgacagagtaggttaatcgtcagtttcaggagataagacacaattttgaaagtacagcagaggctgctattaatgtatcatgttgagtttctgttatgttatgttattcttttttaatctcaaaaaaaaaaaaaaaaa

SEQ ID NO: 340 - DNA, 2084 bp, Vernicia fordii
tctctctctctttgctttacgtgtacatcgaccaccaccacagccatcttgcgactgttcaattatcctataagtaccaccgcattcatcaccgccaatccttaactctaatttgctatactaaacacttgctttatatgcgcttttctatttactcttcactgtaatttcttattggtattcaaagtgttttcaatgacaatccctgaaacgccggataattccacggatgctaccaccagtggcggtgctgagtcctcttccgatcttaacctttctcttcgacggaggaggactgcttcaaactccgatggagctgtcgcggaattggcttccaagattgatgagttggaatctgatgccggaggaggccaggtgattaaggatccgggagcagaaatggattcggggactttgaaaagtaatggaaaagattgcggaaccgttaaggataggattgaaaatcgtgagaatcgtggaggatcggatgttaaattcacgtatcggccgtcggtgccggctcaccgggcgctcaaggagagtccgcttagctctgataatatatttaaacaaagtcatgcaggtctcttcaatctctgtatagtagtgcttgtagcggttaacagtcggcttatcattgaaaacataatgaagtatggttggttaattaagactgggttttggtttagttcaagatcgttgagagactggccacttcttatgtgctgtcttaccctcccaatattttctcttgctgcctatctagttgagaagttggcctgtcggaagtatatatctgcacccactgttgtttttcttcatattcttttctcctcaacagcagttttataccctgtttctgtgattctcagttgtgaatctgctgttttgtccggtgtcgcattgatgctctttgcttgtatcgtgtggttgaaattggtatcttatgcacatacaaactttgatatgagagcaattgctaactcagttgataagggagatgcgctatccaatgcttcgagtgcagagtcctctcatgatgttagcttcaagagtttggtttatttcatggttgctcccacattgtgttaccagccaagttatcctcgaactgcatccattcgaaagggttgggtggttcgtcaatttgttaagttaataatatttacaggattcatgggatttatcatagaacaatatatcaatcctatcgttcagaattcacaacatcctttaaaaggggatctcttatatgccattgagagggttttgaagctctcagttccgaatttatatgtctggctttgcatgttctactgcttttttcacctatggttaaatatacttgctgagctccttcgctttggtgatagagagttctataaagattggtggaatgcaaggacagttgaggagtattggagaatgtggaatatgcctgttcataagtggatggttcgccatatctactttccatgcttgcggcataaaataccaaggggggtggccttattaattactttcttcgtttcagcagtatttcatgagttgtgcattgctgttccttgccacatattcaagctctgggcttttattggaataatgtttcagattcctttggtcgggatcacaaattaccttcaaaacaagttcagaagctcaatggtggggaacatgatcttctggttcattttctgcattcttggtcaaccaatgtgcttgctgttgtattaccatgacctaatgaatcgaaaagggactaccgaatcaagatgacactaactcatcgtgtggtagactctatatatatacatagacttaccagagatgggttgcttccaacatattgtgcacaagaggcaattgttgttctcatcagaagagtgggttaattaattaattaatgtacaagcaattttgaaagtataatcactggcagggactagtgcccgactgtagtactgagattatagaggtattatcaatcgttagtggaaaattgtaaatgtataaagttcaatctttgtattgtttcttttctaatatcatatttttttttattgctcatcaaaaaaaaaaaaaaa

SEQ ID NO: 341 - DNA, 1828 bp, Vernonia galamensis
tctgagctcaaatcaaatttctgcgactcatacaggattcaactcaatactttcttgatcggttctgctgttcatttacttgtaatttctacttctgctttgctttcatttcaagcttttttccttaataatggcgttattagatacgcctcagattggagaaataacgaccaccgccaccacaactataagacggcggaccactgtcaagcctgatgctggaatcggagatggattgtttgattcttcgtcgtcttccaaaaccaactcatccttcgaggatggtgacagtttgaatggtgatttcaatgacaaatttaaggaacagatcggagctggtgatgaatccaaggacgactccaaggggaacggacagaagatagatcacggaggagttaaaaagggacgtgaaacgactgtggtgcattatgcttatcggccttcttctccggctcatcggagaattaaagaatctccgcttagctctgacgccatcttcaagcagagtcatgcaggcctctttaacctttgcatagtggtgcttgttgcagtaaatggtaggctcatcattgagaatctgatgaagtatggactattgatcaattccaacttttggttcagttcgagatcattgagagactggccacttctgatgtgctgcctcactccttctgactttccacttgctgcctacattgttgagaaattggcatggaaaaaacgtatatccgaccctgttgtaatcacactccatgttataataactacaactgcaattctttatccggtcttcatgattctgaggttcgattcagttgttctatcaggcgtctcgttgatgctgtgtgcttgcattaattggttgaagttggtatcttttgtgcatacaaattatgacatgcggtcgcttttgaactcaactgataagggagaagtggaacccatgtcttcaaatatggattatttttatgatgtcaacttcaaaagcttggtttatttcatggttgctccaactttgtgttaccagataagctatcctcgcactgcatttattcgaaagggttgggtgttacggcaactgatcaagctagtaatatttacagggttcatgggattcatcattgaacaatatatcaatccgattgtcaaaaattctcgtcatccattgaaaggagactttttatatgcgattgagcgggttttaaagctttcagttccgaatttatatgtgtggctctgtatgttctactgcttttttcacctttggttaaatatacttgctgagcttctttgttttggggatcgtgaattttataaagattggtggaatgcacaaactattgaagagtattggaggctatggaatatgcctgttcataaatggattgttaggcacctttattttccatgcttgcgtaatgggatacctaagggtgctgccatattggttgcatttttcatgtctgccgtgttccatgagctttgtattgctgttccctgccacattttcaagttttgggcttttatcgggatcatgtttcaggtcccgttggtcctactcacaaattacttgcagcacaagtttcaaaactcgatggtgggaaatatgatcttctggtgctttttcagcatttttggtcaacccatgtgtgtattactttactaccatgatgtcatgaatcaaaaggggaaaagcaaataaaaagatgtgattgtgttgctccatttgatctcatagcatgactggactaaacaaacccaagggacacattttagtccttaaaggaaaatttttgtaggaaaaaaaaaaaaaaaaaaaaaaaaaaaa

SEQ ID NO: 342 - DNA, 1738 bp, Vernonia galamensis
gttcgtaattcggctgtggtttcctttccaacatttctacgtaatcatggcgttgttagatacgcctcaaattggagaaataacgacgaccgcaacaacgaccattaggcagcaccccctgggcaagcctgatgctggaattggagatggattgttttcttcgtcgtcttccaaaaccaactcatccttcgaggatggtgacagtttgaatggtgatttcaatgacaaatttaaggaacagatcggagctggtgatgaatccaagaaggggaacggaaagatagatcacggaggagttaaaaagggacgtgaaacgactgtggtgcattatgcttatcggccttcttctccggctcatcggagaattaaagaatctccgcttagctctgacgccatcttcaagcagagtcatgcaggcctctttaacctttgcatagtggtgcttgttgcagtaaatggtaggctcatcatcgagaatctgatgaagtatggactattgattaattccaaattttggttcagttcgagatcattgagagactggccgcttctgatgtgttggctgaccccctccgacttccccctcgccgcctacattgtcgagaaattggcatggaaaaaacgtatatccgaccctgttgtaatcacactccatgttgtaataactacaactgcaattctctatccgatcttcatgattctgaggttcgactcggtcgttctattaggcgtctcgttgatgctgtgtgcttgcattaattggttgaagttggtatcttttgtgcatacaaattatgacatgcggtcgctattgaactcaactggtaagggagaagtggagcccatgtcttcaaatatggactacttttatgatatcaacttcaaaagcttggtttatttcatggttgctccaactttgtgttaccagataagctatcctcgcaccgcctttattcgaaagggctgggtgttccggcaactgatcaagctagtaatatttacagggttcatgggattcatcattgaacaatatatcaatccgattgtcaaaaattctcggcatccattgaacggagactttttatatgcgattgaacgagtattaaaggtttcagttccgaatttatatgtgtggctctgtatgttctattgcttttttcacctttggttaaatatacttgctgagcttctttggtttggggatcgtgaattttataaagattggtggaatacacaaactattgaagagtattggaggctatggaatatgcctgttcataagtggattgttaggcacctctattttccatgcttgcgtaatgggatatctaagggtgctgccatattggttgcttttttcatgtctgccgtgttccacgagctttgcatagctgttccctgccacattttaaagttttgggctttcatcgggatcatgttccaggtcccgttggtactactcacaaattacttgcagcacaagtttcaaaactcgatggtgggaaacatgatcttttggtgcttcttcagcattttcggtcaacccatgtgtgtatttctttactaccatgaagtcaatcaaaaggggaaaagcaaatgaaaggacgttatcgtatttccccaatctttcttatatcgtgaatctaatatccataacaaagcaaaacaattaagtcactggagaatactattagcaggtaataaagaaccaaacaaaaaaaaaaaaaaaaaaaaaaaa

SEQ ID NO: 343 - DNA, 1524 bp, Euonymus alatus
atggctgctaacttgaacgaagcctcggatcttaatttttcgcttcggaggagaactggtggcatctcaagtacgactgtgcctgattctagttccgagacaagttcgtcggaggcggactatttggacggaggcaaaggtgccgcggacgtcaaagatcgtggggatggtgcggtggagtttcagaattcgatgaagaacgtggagaggattgagaaacatgagagccgagtaggattggattcgagattcacgtataggccatcggtcccggctcatcgcacaataaaggagagcccgcttagctcggacgcaatattcaaacagagtcacgcaggtctcttcaatctctgtatagtagttctggttgctgtgaacagcaggctgatcattgaaaatctaatgaagtatggatggttaataaggagtgggttttggttcagctcaagatcattgagagactggcccctttttatgtgttgtctcacactaccagtattccctcttgctgcttttctgtttgagaagttggctcaaaaaaatttaatatctgaacctgttgttgttttgcttcatatagtaaacactacagctgccgttttataccctgttttggtgattctaaggtgtgattctgcctttatgtctggggttacgttgatgctctttgcttgtattgtgtggttaaagttggtatcttatgctcataccaactatgatatgagagccctcaccaagtctgttgaaaagggggacacgccgttgagctctcagaacatggattactcgtttgatgtcaatatcaagagtttggcatattttatggttgctcccacattatgttaccagattagctatcctcgtaccccatatgttcgcaagggttgggtggttcgtcaatttgtcaagttaataatatttactggacttatgggatttataattgaacaatatatcaatcctattgtccagaattcacaacaccctttgaaaggaaactttttgtatgccattgagagagttttgaagctttcagtcccaaacctttatgtttggctctgcatgttctactgcctttttcatctctggttaaacatacttgctgaacttctttgttttggtgatcgtgagttctacaaggattggtggaacgctaaaactgttgaggagtactggagaatgtggaacatgcctgttcataagtggatggttcgtcatatctacttcccatgcttgaggaacgggatacccaagggtgttgcttttgtcatttccttcttagtttctgccgtcttccatgagctatgcattgctgttccctgccacatcttcaagttatgggctttctttggaataatgcttcaggttcccttggtgttgatcacaagttatctgcaaaataagttcagaagctcaatggtgggaaatatgatgttttggttctctttctgcatttttggtcaacctatgtgcttacttctatattaccatgatttgatgaatcgcaatgggaagatggagtag

SEQ ID NO: 344 - DNA, 1497 bp, Caenorhabditis elegans
atgcaaatgcgtcaacaaacgggacgacggcggcgtcagccttcggaaacatctaatggttctttggcttccagtagacgctcctcatttgcacaaaatggtaattcgtcaaggaaaagttcagaaatgagagggccttgcgagaaagtggtacatactgctcaagattcattgttttcgacgagttctggatggacaaatttccgtggattcttcaatttgtctattttacttttggtactttcaaatggacgcgtggcacttgaaaatgtgatcaaatatggtattttgataacaccccttcagtggatctcaacgtttgttgagcatcactactcaatttggagctggccaaatcttgctctcatcctatgctcaaatattcagattctctcggtttttggaatggaaaaaattcttgaacgtggatggcttggaaacggattcgctgcagtgttctacacctcgcttgtgattgcacatctgacaattccagttgtggtcactcttacccacaaatggaagaatcctttgtggtcagtcgtaatgatgggtgtttatgttattgaagctctcaaattcatctcatatggccacgtcaactactgggctcgtgatgctcggcgaaaaatcacagagctcaaaacacaagtcaccgatttggcaaagaaaacatgtgatccgaaacaattttgggatttgaaagatgaattatcaatgcatcagatggctgctcaatatcctgccaatttgacactttccaatatctactacttcatggctgcaccaacattgtgctacgaattcaaatttccaagattgttgcgaattcggaagcactttttgattaaaagaaccgtggagcttatctttctatcgtttttgatagctgcacttgttcaacaatgggttgttccgactgtccgaaatagtatgaaacctttaagtgaaatggaatactctagatgtttggaacgactcttgaaacttgcaattccaaatcatctcatctggcttctattcttctacacattcttccattcatttttgaacttgatcgccgagctgcttcgatttgccgatcgtgagttctacagagacttttggaatgcagagacgataggatatttctggaaatcatggaacatcccagttcaccgatttgctgttcgccacatctacagtccaatgatgcgtaacaatttctcaaaaatgagcgcattcttcgttgtgttcttcgtgtcggcattcttccatgaatatctggtttctgtgccattaaagattttccgattgtggtcctactatggaatgatgggacaaattcctctatccattatcactgataaagtggtgagaggtggacgtacaggaaacatcatcgtctggctctcactgattgttggccaacctcttgcaattctcatgtacggacatgattggtacattttgaactttggtgtttcagcagttcaaaaccaaaccgttggtatttga

SEQ ID NO: 345 - DNA, 1751 bp, Rattus norvegicus
gaagattgggccgcgacgaggtgcgggccgaagccatgggcgaccgcggaggcgcgggaagctctcggcgtcgcaggaccggctcgcgggtttccgtccagggaggtagtgggcccaaggtagaagaggacgaggtgcgagaagcggctgtgagccccgacttgggcgccgggggtgacgcgccggctccggctccggctccagcccatacccgggacaaagaccggcagaccagcgtgggcgacggccactgggagctgaggtgccatcgtctgcaagactctttgttcagctcagacagcggtttcagcaattaccgtggtatcctgaattggtgcgtggtgatgctgatcctgagtaatgcaaggttatctttagagaatcttatcaagtatggcatcctggtggatcccatccaggtggtgtctctgtttctgaaggacccctacagctggcctgccccatgcttgatcattgcatccaatatctttattgtggctacatttcagattgagaagcgcctgtcagtgggtgccctgacagagcagatggggctgctgctacatgtggttaacctggccacaattatctgcttcccagcagctgtggccttactggttgagtctatcactccagtgggttccctgtttgctctggcatcatactccatcatcttcctcaagctttcttcctaccgggatgtcaatctgtggtgccgccagcgaagggtcaaggccaaagctgtgtctgcagggaagaaggtcagtggggctgctgcccagaacactgtaagctatccggacaacctgacctaccgagatctctattacttcatctttgctcctactttgtgttatgaactcaactttcctcgatccccccgaatacgaaagcgctttctgctacggcgggttcttgagatgctctttttcacccagcttcaagtggggctgatccagcagtggatggtccctactatccagaactccatgaagcccttcaaggacatggactattcacgaatcattgagcgtctcttaaagctggcggtccccaaccatctgatatggctcatcttcttctattggcttttccactcatgtctcaatgctgtggcagagctcctgcagtttggagaccgcgagttctacagggactggtggaatgctgagtctgtcacctacttttggcagaactggaatatccccgtgcacaagtggtgcatcagacacttttacaagcctatgctcagactgggcagcaacaaatggatggccaggactggggtcttttgggcgtcagctttctttcatgagtacctagtgagcattcccctgaggatgttccgcctttgggcattcacagcaatgatggctcaggtcccactggcctggattgtgaaccgcttcttccaagggaactatggcaatgcagctgtgtgggtgacactcatcattgggcaaccggtggctgtgctcatgtatgtccacgactactacgtgctcaactatgatgccccagtgggggcatgagctactgccaaaggccagcctccctaacctgggcctggagttctggagggcttcctgctgctgcacactcccctagtttggaggcctttctgcccctatggggcctactcctgctcttggggatggccctgagccagctggttgagccagtgctgggagtttgtgctgaccaggggcttaggatatcaataaagagctatctaaaaaaaaaaaaaaaaa

SEQ ID NO: 346 - DNA, 3718 bp, Homo sapiens
cgcctcaggtcggccgcggactacaaatggacgagagaggcggccgtccattagttagcggctccggagcaacgcagccgttgtccttgaggccgacgggcctgacgcgggcgggttgaacgcgctggtgaggcggtcacccgggctacggcggccggcagggggcagtggcggccgttgtctagggcccggaggtggggccgcgcgcctcgggcgctacgaacccggcaggcccacgcttggctgcggccgggtgcgggctgaggccatgggcgaccgcggcagctcccggcgccggaggacagggtcgcggccctcgagccacggcggcggcgggcctgcggcggcggaagaggaggtgcgggacgccgctgcgggccccgacgtgggagccgcgggggacgcgccagccccggcccccaacaaggacggagacgccggcgtgggcagcggccactgggagctgaggtgccatcgcctgcaggattctttattcagctctgacagtggcttcagcaactaccgtggcatcctgaactggtgtgtggtgatgctgatcttgagcaatgcccggttatttctggagaacctcatcaagtatggcatcctggtggaccccatccaggtggtttctctgttcctgaaggatccctatagctggcccgccccatgcctggttattgcggccaatgtctttgctgtggctgcattccaggttgagaagcgcctggcggtgggtgccctgacggagcaggcgggactgctgctgcacgtggccaacctggccaccattctgtgtttcccagcggctgtggtcttactggttgagtctatcactccagtgggctccctgctggcgctgatggcgcacaccatcctcttcctcaagctcttctcctaccgcgacgtcaactcatggtgccgcagggccagggccaaggctgcctctgcagggaagaaggccagcagtgctgctgccccgcacaccgtgagctacccggacaatctgacctaccgcgatctctactacttcctcttcgcccccaccttgtgctacgagctcaactttccccgctctccccgcatccggaagcgctttctgctgcgacggatccttgagatgctgttcttcacccagctccaggtggggctgatccagcagtggatggtccccaccatccagaactccatgaagcccttcaaggacatggactactcacgcatcatcgagcgcctcctgaagctggcggtccccaatcacctcatctggctcatcttcttctactggctcttccactcctgcctgaatgccgtggctgagctcatgcagtttggagaccgggagttctaccgggactggtggaactccgagtctgtcacctacttctggcagaactggaacatccctgtgcacaagtggtgcatcagacacttctacaagcccatgcttcgacggggcagcagcaagtggatggccaggacaggggtgttcctggcctcggccttcttccacgagtacctggtgagcgtccctctgcgaatgttccgcctctgggcgttcacgggcatgatggctcagatcccactggcctggttcgtgggccgctttttccagggcaactatggcaacgcagctgtgtggctgtcgctcatcatcggacagccaatagccgtcctcatgtacgtccacgactactacgtgctcaactatgaggccccagcggcagaggcctgagctgcacctgagggcctggcttctcactgccacctcacacccgctgccagagcccacctctcctcctaggcctcgagtgctggggatgggcctggctgcacagcatcctcctctggtcccagggaggcctctctgcccctatggggctctgtcctgcacccctcagggatggcgacagcaggccagacacagtctgatgccagctgggagtcttgctgaccctgccccgggtccgagggtgtcaataaagtgctgtccagtgacctcttcagcctgccaggggcctggggcctggtggggggtatggccacacccacaagggcgagtgccagagctgtgtggacagctgtcccaggacctgccggggagcagcagctccactgcagcagggcgggcatggccggtagggggagtgcaaggccaggcagacgcccccattccccacactcccctacctagaaaagctcagctcaggcgtcctctcctggtgctactcctgctgggtgtgcgggaatcggcactctggccctcagtgcaggatggtcaacttgcacccaccgtgctcagcttcagcttgggaagaggtcggccctgggtttgcgggaagtgggctccagccaggatggcccagggatgggcagtccacagggcctttctggtgtgggtctggtgagccgaggggctacggtacacaatggctatgtccatggctattcgccttggggcagggctcggtttggcagcctctttccttcacttggaacctgggcagccaggtgggctggtggctctcagctgccctccacgaggttggggcacccctgatccccaggcctgccttgccctctgctcttctggcaccaggctgggcagtgcagacagcgcagccctgcagccttcaggacaccttgttcccaggccctgcaatccaccaagctggatagatggggccccccttgatggtagcgggaggtcaggggtaaccccagggccctgctgctgccttaccttgctggggtgactgcttgattaaagaccccaagactggaccaggccctggtgtccccagacctgcagctatggcccaacaaggcaggtgtttgaggaggccctgcacagggtcccaggactgcaccaggggcctcatcagcaacctgctgaactggtggtgtgaggggagggtgggctcccttggtggtatcctccctctaccccagtgggggctggtgggccctgagatggaggcatctccttgggccctgctgaggatggcagtagtgggtgagctcctggtggggggatgggtgtggggccgactcctccatcccacatgggctcctgtgcctctccctatcagttggccagtggagctcgagaacaaactgttgctgccagataaagcagcaaagcctgctccactgcccagcgcaggcccccttcccttcctccaccaggctgagtggagaaccctaaagctacgggacaggctcccgttccccgtgcctacacagggtgctggctctggcagaaagacagtgtgcccgccccgcatcacctgtccgagtgcgaacaccttgggaagggggttcctggtggtcctgtgacaaccagagacccccagggccaaggtgaggcgcccacccctggtccctcaataaagaactgcaagcacatgctggtcctggggagtcgggcaggcacggagctagctgcaagcatccgtcttcccccaggaggccactgcagcccggcccttctgtgccctgggcccctcctcattgcagcaccacccaccgcaccaccctgggacagaggaaacacatggaggccatagcatagagcctgtctgtttatagatctctgcctgtcttgtccgtccatccactgtgtgtatatatctgtgtatctctgtggagcggggaacgggacagttgtgtaaaaatccaaaatacaattctgactatgaacaaaaaaaaaaaaaaa

SEQ ID NO: 347 - protein, 508 aa, Aspergillus fumigatus
MKMSASKTVTSSASAVSTSSGRSTPSKLVNGATRNGSAAAGNGSTGTAKGKRRSKYRHVAAYHSELRHSSLSRETSVVPSFLGFRNLMVIVLVAMNLRLIIENFMKYGVLICIKCHDYRKQDVVLGSILFALVPCHLFLAYIIELVAAQQSKKTVGRQKKDLSTEEREREQQAFRSTWRYTAFFHTVNATLCLAVTSFVVYFYINHPGIGTICELHAIIVWLKNCSYAFTNRDLRQAMVDPSAESALPEIYSTCPYPRNITLGNLTYFWLAPTLVYQPVYPRSSHIRWSFVAKRLAEFFGLAVFIWLLSAQYAAPVLRNSIDKIAVMDIASILERVMKLSTISLVIWLAGFFALFQSLLNALAEVMRFGDREFYTDWWNSPSLGAYWRSWNRPVYLFMKRHVFSPLVGRGWSPFAASFMVFSLSAVLHEMLVGIPTHNLIGVAFAGMMFQLPLIAVTAPFEKVNDALGKIVGNSIFWVSFCLVGQPLGALLYFFAWQAKYGSVSKIHV

SEQ ID NO: 348 - protein, 521 aa, Ricinus communis
MTILETPETLGVISSSATSDLNLSLRRRRTSNDSDGALADLASKFDDDDDVRSEDSAENIIEDPVAAVTELATAKSNGKDCVANSNKDKIDSHGGSSDFKLAYRPSVPAHRSLKESPLSSDLIFKQSHAGLFNLCIVVLVAVNSRLIIENLMKYGWLIKTGFWFSSRSLRDWPLFMCCLSLPVFPLAAYLVEKAAYRKYISPPIVIFLHVIITSAAVLYPASVILSCESAFLSGVTLMELACMVWLKLVSYAHTNYDMRAIADTIHKEDASNSSSTEYCHDVSFKTLAYFMVAPTLCYQPSYPRTAFIRKGWVFRQFVKLIIFTGFMGFIIEQYINPIVQNSQHPLKGDLLYAIERVLKLSVPNLYVWLCLFYCFFHLWLNIVAELLRFGDREFYKDWWNAKTVEEYWRMWNMPVHKWMVRHIYFPCLRRKIPRGVAIVIAFFVSAVFHELCIAVPCHMFKLWAFFGIMFQIPLVVITNYFQRKFRSSMVGNMIFWFFFCILGQPMCVLLYYHDLMNRDGN

SEQ ID NO: 349 - protein, 526 aa, Vernicia fordii
MTIPETPDNSTDATTSGGAESSSDLNLSLRRRRTASNSDGAVAELASKIDELESDAGGGQVIKDPGAEMDSGTLKSNGKDCGTVKDRIENRENRGGSDVKFTYRPSVPAHRALKESPLSSDNIFKQSHAGLFNLCIVVLVAVNSRLIIENIMKYGWLIKTGFWFSSRSLRDWPLLMCCLTLPIFSLAAYLVEKLACRKYISAPTVVFLHILFSSTAVLYPVSVILSCESAVLSGVALMLFACIVWLKLVSYAHTNFDMRAIANSVDKGDALSNASSAESSHDVSFKSLVYFMVAPTLCYQPSYPRTASIRKGWVVRQFVKLIIFTGFMGFIIEQYINPIVQNSQHPLKGDLLYAIERVLKLSVPNLYVWLCMFYCFFHLWLNILAELLRFGDREFYKDWWNARTVEEYWRMWNMPVHKWMVRHIYFPCLRHKIPRGVALLITFFVSAVFHELCIAVPCHIFKLWAFIGIMFQIPLVGITNYLQNKFRSSMVGNMIFWFIFCILGQPMCLLLYYHDLMNRKGTTESR

SEQ ID NO: 350 - protein, 523 aa, Vernonia galamensis
MALLDTPQIGEITTTATTTIRRRTTVKPDAGIGDGLFDSSSSSKTNSSFEDGDSLNGDFNDKFKEQIGAGDESKDDSKGNGQKIDHGGVKKGRETTVVHYAYRPSSPAHRRIKESPLSSDAIFKQSHAGLFNLCIVVLVAVNGRLIIENLMKYGLLINSNFWFSSRSLRDWPLLMCCLTPSDFPLAAYIVEKLAWKKRISDPVVITLHVIITTTAILYPVFMILRFDSVVLSGVSLMLCACINWLKLVSFVHTNYDMRSLLNSTDKGEVEPMSSNMDYFYDVNFKSLVYFMVAPTLCYQISYPRTAFIRKGWVLRQLIKLVIFTGFMGFIIEQYINPIVKNSRHPLKGDFLYAIERVLKLSVPNLYVWLCMFYCFFHLWLNILAELLCFGDREFYKDWWNAQTIEEYWRLWNMPVHKWIVRHLYFPCLRNGIPKGAAILVAFFMSAVFHELCIAVPCHIFKFWAFIGIMFQVPLVLLTNYLQHKFQNSMVGNMIFWCFFSIFGQPMCVLLYYHDVMNQKGKSK

SEQ ID NO: 351 - protein, 517 aa, Vernonia galamensis
MALLDTPQIGEITTTATTTIRQHPLGKPDAGIGDGLFSSSSSKTNSSFEDGDSLNGDFNDKFKEQIGAGDESKKGNGKIDHGGVKKGRETTVVHYAYRPSSPAHRRIKESPLSSDAIFKQSHAGLFNLCIVVLVAVNGRLIIENLMKYGLLINSKFWFSSRSLRDWPLLMCWLTPSDFPLAAYIVEKLAWKKRISDPVVITLHVVITTTAILYPIFMILRFDSVVLLGVSLMLCACINWLKLVSFVHTNYDMRSLLNSTGKGEVEPMSSNMDYFYDINFKSLVYFMVAPTLCYQISYPRTAFIRKGWVFRQLIKLVIFTGFMGFIIEQYINPIVKNSRHPLNGDFLYAIERVLKVSVPNLYVWLCMFYCFFHLWLNILAELLWFGDREFYKDWWNTQTIEEYWRLWNMPVHKWIVRHLYFPCLRNGISKGAAILVAFFMSAVFHELCIAVPCHILKFWAFIGIMFQVPLVLLTNYLQHKFQNSMVGNMIFWCFFSIFGQPMCVFLYYHEVNQKGKSK

SEQ ID NO: 352 - protein, 507 aa, Euonymus alatus
MAANLNEASDLNFSLRRRTGGISSTTVPDSSSETSSSEADYLDGGKGAADVKDRGDGAVEFQNSMKNVERIEKHESRVGLDSRFTYRPSVPAHRTIKESPLSSDAIFKQSHAGLFNLCIVVLVAVNSRLIIENLMKYGWLIRSGFWFSSRSLRDWPLFMCCLTLPVFPLAAFLFEKLAQKNLISEPVVVLLHIVNTTAAVLYPVLVILRCDSAFMSGVTLMLFACIVWLKLVSYAHTNYDMRALTKSVEKGDTPLSSQNMDYSFDVNIKSLAYFMVAPTLCYQISYPRTPYVRKGWVVRQFVKLIIFTGLMGFIIEQYINPIVQNSQHPLKGNFLYAIERVLKLSVPNLYVWLCMFYCLFHLWLNILAELLCFGDREFYKDWWNAKTVEEYWRMWNMPVHKWMVRHIYFPCLRNGIPKGVAFVISFLVSAVFHELCIAVPCHIFKLWAFFGIMLQVPLVLITSYLQNKFRSSMVGNMMFWFSFCIFGQPMCLLLYYHDLMNRNGKME

SEQ ID NO: 353 - protein, 498 aa, Caenorhabditis elegans
MQMRQQTGRRRRQPSETSNGSLASSRRSSFAQNGNSSRKSSEMRGPCEKVVHTAQDSLFSTSSGWTNFRGFFNLSILLLVLSNGRVALENVIKYGILITPLQWISTFVEHHYSIWSWPNLALILCSNIQILSVFGMEKILERGWLGNGFAAVFYTSLVIAHLTIPVVVTLTHKWKNPLWSVVMMGVYVIEALKFISYGHVNYWARDARRKITELKTQVTDLAKKTCDPKQFWDLKDELSMHQMAAQYPANLTLSNIYYFMAAPTLCYEFKFPRLLRIRKHFLIKRTVELIFLSFLIAALVQQWVVPTVRNSMKPLSEMEYSRCLERLLKLAIPNHLIWLLFFYTFFHSFLNLIAELLRFADREFYRDFWNAETIGYFWKSWNIPVHRFAVRHIYSPMMRNNFSKMSAFFVVFFVSAFFHEYLVSVPLKIFRLWSYYGMMGQIPLSIITDKVVRGGRTGNIIVWLSLIVGQPLAILMYGHDWYILNFGVSAVQNQTVGI

SEQ ID NO: 354 - protein, 498 aa, Rattus norvegicus
MGDRGGAGSSRRRRTGSRVSVQGGSGPKVEEDEVREAAVSPDLGAGGDAPAPAPAPAHTRDKDRQTSVGDGHWELRCHRLQDSLFSSDSGFSNYRGILNWCVVMLILSNARLSLENLIKYGILVDPIQVVSLFLKDPYSWPAPCLIIASNIFIVATFQIEKRLSVGALTEQMGLLLHVVNLATIICFPAAVALLVESITPVGSLFALASYSIIFLKLSSYRDVNLWCRQRRVKAKAVSAGKKVSGAAAQNTVSYPDNLTYRDLYYFIFAPTLCYELNFPRSPRIRKRFLLRRVLEMLFFTQLQVGLIQQWMVPTIQNSMKPFKDMDYSRIIERLLKLAVPNHLIWLIFFYWLFHSCLNAVAELLQFGDREFYRDWWNAESVTYFWQNWNIPVHKWCIRHFYKPMLRLGSNKWMARTGVFWASAFFHEYLVSIPLRMFRLWAFTAMMAQVPLAWIVNRFFQGNYGNAAVWVTLIIGQPVAVLMYVHDYYVLNYDAPVGA

SEQ ID NO: 355 - protein, 488 aa, Homo sapiens
MGDRGSSRRRRTGSRPSSHGGGGPAAAEEEVRDAAAGPDVGAAGDAPAPAPNKDGDAGVGSGHWELRCHRLQDSLFSSDSGFSNYRGILNWCVVMLILSNARLFLENLIKYGILVDPIQVVSLFLKDPYSWPAPCLVIAANVFAVAAFQVEKRLAVGALTEQAGLLLHVANLATILCFPAAVVLLVESITPVGSLLALMAHTILFLKLFSYRDVNSWCRRARAKAASAGKKASSAAAPHTVSYPDNLTYRDLYYFLFAPTLCYELNFPRSPRIRKRFLLRRILEMLFFTQLQVGLIQQWMVPTIQNSMKPFKDMDYSRIIERLLKLAVPNHLIWLIFFYWLFHSCLNAVAELMQFGDREFYRDWWNSESVTYFWQNWNIPVHKWCIRHFYKPMLRRGSSKWMARTGVFLASAFFHEYLVSVPLRMFRLWAFTGMMAQIPLAWFVGRFFQGNYGNAAVWLSLIIGQPIAVLMYVHDYYVLNYEAPAAEA

SEQ ID NO: 356 - protein, 11 aa, Artificial Sequence
  conserved sequence
  X (4)..(4): Threonine (T) or Serine (S)
RGVXRHRWTGR

SEQ ID NO: 357 - protein, 8 aa, Artificial Sequence
  conserved sequence
  X (1)..(1): Phenylalanine (F) or Tyrosine (Y)
XEAHLWDK

SEQ ID NO: 358 - protein, 9 aa, Artificial Sequence
  conserved sequence
DLAALKYWG

SEQ ID NO: 359 - protein, 8 aa, Artificial Sequence
  conserved sequence
  misc_feature (2)..(2): Xaa can be any naturally occurring amino acid
  X (5)..(5): Serine (S) or Alanine (A)
  X (8)..(8): any amino acid
SXGFXRGX

SEQ ID NO: 360 - protein, 14 aa, Artificial Sequence
  conserved sequence
  X (3)..(3): Histidine (H) or Gutamine (Q)
  X (6)..(6): Arginine (R) or Lysine (K)
  X (12)..(12): Arginine (R) or Lysine (K)
  misc_feature (13)..(13): Xaa can be any naturally occurring amino acid
HHXNGXWEARIGXV

SEQ ID NO: 361 - protein, 9 aa, Artificial Sequence
  conserved sequence
  X (7)..(7): any amino acid
QEEAAAXYD

SEQ ID NO: 362 - protein, 165 aa, Brassica napus
MGILRKKKHERKPSFKSVLTAILATHAATFLLLIAGVSLAGTAAAFIATMPLFVVFSPILVPAGITTGLLTTGLAAAGGAGATAVTIILWLYKRATGKAPPKVLEKVLKKIIPGAAAAPAAAPGAAPAAAPAAAPAVAPAAAPAAAPAPKPAAPPAPKPAAAPSI

SEQ ID NO: 363 - protein, 193 aa, Brassica napus
MADVRTHAHQVQVHPLRQQEGGIKVVYPQSGPSSTQVLAVIAGVPVGGTLLTLAGLTLAGSVIGLMLAFPLFLIFSPVIVPAAFVIGLAMTGFMASGAIGLTGLSSMSWVLNHIRRVRERMPDELEEAKQRLADMAEYVGQRTKDAGQTIEEKAHDVRESKTYDVRDRDTKGHTATGGDRDTKTTREVRVATT

SEQ ID NO: 364 - protein, 188 aa, Brassica napus
MANVDRRVNVDRTDKGLQLQPQYEDRVGYGYGYGGNTDYKSCGPSTNQIVALIAGVPIGGSLLALAGLTLAGSVIGFMLSIPLFLLFSPVIVPAALTIGLAVTGILASGLFGLTGLSSVSWVLNYIRGRSDTVPEQLDYAKRRMADAVGYAGQKGKEMGQYVQDKAHEAHDTSLTTETNGKTRRAHIA

SEQ ID NO: 365 - protein, 180 aa, Brassica napus
MADTARTHHDITSRDQYPILGRDRDQYPYGRSDYQTSGQDYSKTRQIAKAATAVTAGGSLLVLSSLTLVGTVIALTVATTLLVIFSPILVPALITVALLITGFLSSGGFGIADITVFSWIYKYATGEHPQGSDKLDSARMKLGTKAQDIKDRAQYYGQQHTGGEHDRDRTRGTHHTTTTT

SEQ ID NO: 366 - protein, 210 aa, Brassica napus
MADTHRVDRTDRHLQFQSPYEGGRVSIQYEGGGGAGGYGGRGGGYGAEGYKSMMPERGPSSTQVLSFLVGVPIVGSLLAIAGLLLAGSVIGLLISIPLFLLFSPVIVPAALTIGLAATGFLASGMFGLTGLSSVSWVLNYLRGTRKSSVPEQLEYAKKRMADAVGYAGQKGKGMGQHVQNKAQEAKQYDISKTHDTTTKGHETTQRTAAA

SEQ ID NO: 367 - protein, 149 aa, Brassica napus
MANQTRTHQDIIVRDSRITLDRDHPKTGAQMVKVATGVAAGGSLLVLSGLTLAGTVIAFAVATPLLIIFSPVLVPAVITVVLIITGFLASGGFGIAAITAFSWLYRHMTGSGSDQKIESARMKVGSRGYDTKYGQHNIGVHQQHQQAAS

SEQ ID NO: 368 - protein, 137 aa, Arachis hypogaea
MAEALYYGGRQRQEQPRSTQLVKATTAVVAGGSLLILAGLVLAGTVIGLTTITPLFVIFSPVLVPAVITVALLGLGFLASGGFGVAAITVLTWIYRYVTGKHPPGANQLDTARHKLMGKAREIKDFGQQQTSGAQAS

SEQ ID NO: 369 - protein, 150 aa, Arachis hypogaea
MTDRTQPHAVQVHTTAGRFGDTAAGTNRYADRGPSTSKVIAVITGLPIGGTLLLFAGLALAGTLLGLAVTTPLFILFSPVIVPATIVVGLSVAGFLTSGACGLTGLSSFSWVMNYIRQTHGSVPEQLEMAKHRMADVAGYVGQKTKDVGQ

SEQ ID NO: 370 - protein, 166 aa, Arachis hypogaea
MSDQTRTGYGGGGSYGSSYGGGGTYGSSYGTSYDPSTNQPIRQAIKFMTASTIGVSFLILSGLILTGTVIGLIIATPLLVIFSPILVPAAITLALAAGGFLFSGGCGVAAIAALSWLYSYVTGKHPAGSDRLDYAKGVIADKARDVKDRAKDYAGAGRAQEGTPGY

SEQ ID NO: 371 - protein, 176 aa, Arachis hypogaea
MATATDRAPHQVQVHTPTTQRVDVPRRGYDVSGGGIKTLLPERGPSTSQIIAVLVGVPTGGTLLLLSGLSLLGTIIGLAIATPVFIFFSPVIVPAVVTIGLAVTGILTAGACGLTGLMSLSWMINFIRQVHGTTVPDQLDSVKRRMADMADYVGQKTKDAGQEIQTKAQDVKRSSS

SEQ ID NO: 372 - protein, 153 aa, Ricinus communis
MADRPQPHQVQVHRYDPTTGYKGQQKGPSASKVLAVLTFLPVGGGLLSLSGITLTNTLIGMAIATPLFILFGPIILPAAVVIGLAMMAFMVAGALGLSGLTSQSWALKYFREGTAMPESLDQAKKRMQDMAGYVGMKTKEVGQDIQRKAQEGK

SEQ ID NO: 373 - protein, 138 aa, Ricinus communis
MAEHQQSPVVSHRPRVNQLVKAGTAATAGSSLLFLSGLTLTGTVIALALATPLMVLFSPVLLPAVIIISLIGAGFLTSGGFGFGAILVLSWIYRYVTGKQPPGAESLDQARLKLAGKAREMKDRAEQFGQHVTGQQTS

SEQ ID NO: 374 - protein, 226 aa, Glycine max
MTTQVPPHSVQVHTTTTHRYEAGVVPPGARFETSYEAGVKAASIYHSERGPTTSQVLAVLAGLPVGGILLLLAGLTLAGTLTGLAVATPLFVLFSPVLVPATVAIGLAVAGFLTSGAFGLTALSSFSWILNYIRETQPASENLAAAAKHHLAEAAEYVGQKTKEVGQKTKEVGQDIQSKAQDTREAAARDAREAAARDAREAAARDAKVEARDVKRTTVTATTATA

SEQ ID NO: 375 - protein, 223 aa, Glycine max
MTTVPPHSVQVHTTTHRYEAGVVPPARFEAPRYEAGIKAPSSIYHSERGPTTSQVLAVVAGLPVGGILLLLAGLTLAGTLTGLVVATPLFIIFSPVLIPATVAIGLAVAGFLTSGVFGLTALSSFSWILNYIRETQPASENLAAAAKHHLAEAAEYVGQKTKEVGQKTKEVGQDIQSKAQDTREAAARDARDAREAAARDARDAKVEARDVKRTTVTATTATA

SEQ ID NO: 376 - protein, 155 aa, Linum usitatissimum
MDQTHQTYAGTTQNPSYGGGGTMYQQQQPRSYQAVKAATAATAGGSLIVLSGLILTATVISLIIATPLLVIFSPVLVPALITVGLLITGFLASGGFGVAAVTVLSWIYRYVTGGHPAGGDSLDQARSKLAGKAREVKDRASEFAQQHVTGGQQTS

SEQ ID NO: 377 - protein, 180 aa, Linum usitatissimum
MADRTTQPHQVQVHTQHHYPTGGAFGRYEGVLKGGPYHQQGTGSGPSASKVLAVMTALPIGGTLLALAGITLAGTMIGLAITTPIFVICSPVLVPAALLIGFAVSAFLASGMAGLTGLTSLSWFARYLQQAGQGVGVGVPDSFDQAKRRMQDAAGYMGQKTKEVGQEIQRKSQDVKASDK

SEQ ID NO: 378 - protein, 181 aa, Helianthus annuus
TTTTYDRHFTTTQPHYRQDDRSRYDQQTHSQSTSRTLAIIALLPVGGILLGLAALTFIGTLIGLALATPLFVIFSPIIVPAVLTIGLAVTGFLASGTFGLTGLSSLSYLFNMVRQTAGSVPESLDYVKGTLQDAGEYAGQKTKDFGQKIQSTAHEMGDQGQVGVHAQVGGGKEGRKSGDRT

SEQ ID NO: 379 - protein, 156 aa, Zea mays
MADHHRGATGGGGGYGDLQRGGGMHGEAQQQQKQGAMMTALKAATAATFGGSMLVLSGLILAGTVIALTVATPVLVIFSPVLVPAAIALALMAAGFVTSGGLGVAALSVFSWMYKYLTGKHPPAADQLDHAKARLASKARDVKDAAQHRIDQAQGS

SEQ ID NO: 380 - protein, 244 aa, Brassica napus
VSKPDDCRRIVDETISHFGRLDHLVNNAGIMQISMFENIEEITRTRAVMDTNFWGSVYTTRAALPYLRQSNGKIVAMSSSAAWLTAPRMSFYNASKAALLNFFETLRIELGSDVHITIVTPGYIESELTQGKYFSGEGELVVNQDIRDVQIGAFPVTSVSGCAKGIVKGVCRKQRYVTEPSWFKVTYLWKVFCPELIEWGCRLLFLSGHGTSEKNALNKKILDIPGVRSALYPESIRTPEIKSE

SEQ ID NO: 381 - protein, 349 aa, Brassica napus
MELINDFLNLTAPFFTFFGLCFFLPPFYFFKFVQSIFSTIFSENVYGKVVLITGASSGIGEQLAYEYASKGACLALTARRKNRLEEVAEIAREVGSPNVVTVHADVSKPDDCRRIVDETISHFGRLDHLVNNAGIMQISMFENIEEITRTRAVMDTNFWGAVYTTRAALPYLRQSNGKIVAMSSSAAWLTAPRMSFYNASKAALLNFFETLRIELGSDVHITIVTPGYIESELTQGKYVSGEGELVVNQDIRDVQIGAFPVTSVSGRAKGIVKGVCRKERYVTEPSWFKVTYLWKVFCPELIEWGCRLMFLSGHGTPEENALNKKILDIPGVRSALYPEPIRTPEIKSE

SEQ ID NO: 382 - protein, 456 aa, Brassica napus
MVDLLNSVMNLVAPPATMVVMAFSWPLLCFITFSERLYNSYFVTEDMEDKVVVITGASPAIGEQIAYEYAKRGANLVLVARREQRLRVVSNNARQIGANHVIIIAADVVKEDDCRRFITQAVNYYGRVDHLVNSASLGHTFYFDEVSDTTVFPHLLDINFWGNVYPTYVALPHLQKTNGRIVVNASVENWLPLPRMSLYSAAKAALVNFYETLRFELNGDVGITIATHGWIGSEMSRGKFMLEEGAEMQWKEEREVPANGGPLEEFAKMIVAGACRGDAYVKFPNWYDVFLLYRVFTPNVLRWTFKLLLSSEGSRQSSLVGVGQGLPPEESSSQMKLMLEGGSPRVTASPPRYTPSPSPPHHTASPPRYTPSPSPPHHTSSPQRYTPSPSPPHYTSSRHRYTPSPSPPHYTESPPLYTESPPHYTTSPNWYTESPPRYTPSPSPPRFSRFNIQELP

SEQ ID NO: 383 - protein, 348 aa, Sesamum indicum
MDLIHTFLNLIAPPFTFFFLLFFLPPFQIFKFFLSILGTLFSEDVAGKVVVITGASSGIGESLAYEYAKRGACLVLAARRERSLQEVAERARDLGSPDVVVVRADVSKAEDCRKVVDQTMNRFGRLDHLVNNAGIMSVSMLEEVEDITGYRETMDINFWGYVYMTRFAAPYLRNSRGRIVVLSSSSSWMPTPRMSFYNASKAAISQFFETLRVEFGPDIGITLVTPGFIESELTQGKFYNAGERVIDQDMRDVQVSTTPILRVESAARSIVRSAIRGERYVTEPAWFRVTYWWKLFCPEVMEWVFRLMYLASPGEPEKETFGKKVLDYTGVKSLLYPETVQVPEPKND

SEQ ID NO: 384 - protein, 350 aa, Zea mays
MLGMSRTGLAGAALRVALTALLPLVLPAYYVYKLTTYLLGAVFPEDVAGKVVLITGASSGIGEHLAYEYAKRGAYLALVARREASLREVGDVALGLGSPGVLVLPADVSKPRDCEGFIDDTISYFGRLDHLVNNASIWQVCKFEEIQDVRHLRALMDINFWGHVYPTRLAIPHLRRSRGRIVGVTSNSSYIFIGRNTFYNASKAAALSFYDTLRMELGSDIRITEVVPGVVESEITKGKMLTKGGEMKVDQDERDAILGPTPAEPVGDFARTVVRDVCRGARYVFEPRWYMGVYLLRACLPEVLAWNSRLLTVDTVGASTTDTLGKWLVELPGVRRVVQPPSLRSPEIKD

SEQ ID NO: 385 - protein, 245 aa, Brassica napus
MGTATEIMERDAMATVAPYAPVTFHRRARVDLDDRLPKPYMPRALQAPDREHPYGTPGHKNYGLSVLQQHVAFFDIDDNGIIYPWETYSGLRMIGFNIIGSLIIAAVINLALSYATLPGWLPSPFFPIYIHNIHKSKHGSDSRTYDNEGRFMPVNLELIFSKYAKTLPDKLSLGELWDMTEGQRDAWDIFGWFASKIEWGLLYLLARDEEGFLSKEAIRRCFDGSLFEYCAKIYVGINEDKTAYY

SEQ ID NO: 386 - protein, 244 aa, Brassica napus
MVRESMGEESEAFATTAPLAPVTGERKVRNDLEETLPKPYLARALVAPDTEHPNGSEGHDSKGMSVTQQHVAFFDQNGDGIVYPWETYAGFRDLGFNPISSVFWAIFINFAFSYVTLPSWLPSPLLPVYIDNIHKAKHGSDSSTYDTEGRYVPVNLENIFSKYALTAPNKITLKELWNLTEGNRMAIDPFGWLANKVEWLLVYLLAKDEEGFVSKEAVRGVFDASFFEYCAKKNKEKADSRKQD

SEQ ID NO: 387 - protein, 245 aa, Sesamum indicum
MATHVLAAAAERNAALAPDAPLAPVTMERPVRTDLETSIPKPYMARGLVAPDMDHPNGTPGHVHDNLSVLQQHCAFFDQDDNGIIYPWETYSGLRQIGFNVIASLIMAIVINVALSYPTLPGWIPSPFFPIYLYNIHKAKHGSDSGTYDTEGRYLPMNFENLFSKHARTMPDRLTLGELWSMTEANREAFDIFGWIASKMEWTLLYILARDQDGFLSKEAIRRCYDGSLFEYCAKMQRGAEDKMK

SEQ ID NO: 388 - protein, 243 aa, Zea mays
MSSYSPPPPPPRDQSMDTEAPNAPITRERRLNPDLQEQLPKPYLARALEAVDPSHPQGTKGRDPRGMSVLQQHAAFFDRNGDGVIYPWETFQGLRAIGCGLTVSFAFSILINLFLSYPTQPGWLPSPLLSIRIDNIHKGKHGSDSETYDTEGRFDPSKFDAIFSKYGRTHPNAITRDELSSMLQGNRNTYDFLGWLAAAGEWLLLYSLAKDKDGLLQRETVRGLFDGSLFERLEDDNNKKKSS

SEQ ID NO: 389 - DNA, 737 bp, Brassica napus
gaattccattcaaactagtaaacaatggggatactcaggaagaaaaaacacgagcgaaagccgtcgtttaagagtgttttaaccgcaatattagctacacatgccgcaacattcctcttgttgatcgccggtgtatccctcgccggcacagccgccgcatttatcgctaccatgccactattcgtagtattcagtccgattctcgtaccagctggtattaccactggtttactgactacgggtttagcagccgccggtggcgccggcgcgactgctgtcaccatcatcctgtggctctacaagcgagcaacgggcaaggcgccgccaaaagtcctagaaaaagtcttgaaaaagataataccaggtgctgcagctgcaccagcagccgctccaggagccgctccagcagcggcgccagcagccgcaccagctgtggcgccagcagccgcaccagctgctgcgccagcacctaagccagcagccccaccagcacctaagccagcagccgcaccgagtatatgaaaagaagtggtgggcatgagtaaaggttgatatggaaaactggatacatagaaaaaagagtaatccaacttttaaaaaataaataacaacttcacgtggggatagaaaaattttcaaatattattttactaatggatgtcgcggtacaaaataataacaaatgtaagcctttttattgtatagtattttaagaacgaagctatgtagcgttgaca

SEQ ID NO: 390 - DNA, 837 bp, Brassica napus
tcttgcttttagtttcttgcgtaacaaagatttagcttggaggattaatggcggacgttcgcacacatgctcaccaggttcaagtgcaccctctacgccagcaggaaggaggcatcaaagtggtttatccccagagcgggccttcttccactcaggttctagcagtgatcgccggtgtaccggttggagggacgctgctaactctggccggtttaactttagccggttcggttataggactaatgctggcattcccgctgttcctcatcttcagtccggttatcgtaccagcggcctttgtgatcggtttagctatgacaggattcatggcgtcaggggcaatagggctcacgggactatcgtcgatgtcgtgggtactgaaccacatccgaagagtaagggaacgtatgccggatgagctggaggaagcaaagcagcgtttggctgacatggccgagtatgtggggcagaggacaaaagatgctggacagaccatagaagaaaaagctcacgatgtacgagagagcaagacttatgatgtccgagacagagacacaaagggtcatactgccacaggaggagacagggacaccaagacaactcgcgaggtccgagtggcgacaacatgaggcagcgtgtgttttgtggtgaataaaagagagtcgcctgttgtggttctggtttcttggtagataggtgttgtgtgttttaagcttaaaatggtgttctgctctgtaagcgttctttgagtgttgagtcaattttctttttctttttgtaataataataagtgaaaatgcatcttgtttagtagaaaaagaaaaaaaacaaaaaaaa

SEQ ID NO: 391 - DNA, 809 bp, Brassica napus
gtttagactttgctttttagtagttctagatcatatcaatcgctatggcaaatgtggacaggcgtgtgaatgtcgaccgtactgacaaaggacttcaacttcagccgcagtacgaagatcgtgtcggttatggatatggttatggtggtaatactgattacaagagttgcggcccttccactaaccaaatcgtggcacttatagcaggagttccaattggtggctcattgctagccttagctggactcactctagccggttcggtgataggttttatgctctccattccgctcttcctactcttcagtccggtgattgttccggcagctctcaccatcgggctagctgtaaccggaattttggcgtcagggttatttggtctgacgggtctcagctcggtctcgtgggtcctaaactacatccgtgggaggagtgatacggtgccggagcaattggactatgctaagaggcgtatggctgatgcagtaggctatgctggtcagaagggaaaagagatggggcagtatgtgcaggataaggctcatgaagcacatgatactagtctgaccactgagactaatggtaagacaaggagggcccatatagcgtaagtatgaaagcaccctctgttgtgggcttttgttggaaagacaattatgtaattttacttttgtgtcccagtttttttctcttagaatatattgtcaatgtgtaagttcgttttgtcgtgtccaaataaaatattttgtgggtgaaataagaaaagaactgttgtctgcaaaaaaaaaaaaaaaaaaaaaaaaaaaaaa

SEQ ID NO: 392 - DNA, 891 bp, Brassica napus
gccggggacttcaaaacataaactcatctctctcttcaacaagatcataatggcggatactgctagaactcatcacgacataaccagccgtgaccagtacccgatattgggccgagaccgagaccagtatccttacggacgatcagactaccagacgtcgggccaagactactccaagactaggcagattgctaaagctgctaccgcagtcaccgccggagggtcccttcttgtcctctccagtctcacccttgtcggaacagtcattgctttgactgttgccactactctgcttgttatctttagcccaatcctcgtgccggctctcatcaccgtagcacttctcatcactggctttctctcctctggtgggtttggcattgcagatataaccgtcttctcctggatctataagtacgcaacgggagagcacccacaggggtcagataagttggacagtgcaaggatgaagctgggaaccaaagctcaggatattaaagacagagctcaatactacggacagcaacatacaggtggtgagcatgaccgtgaccgtacccgtggaacccatcacaccaccactactacataaatcacgcaacagcccccagtaatgtcgatgtcaggggagtctagttcatgaggaataaggtgtttagaatttgatcagggtgggtaataaaaggggaagcatatatcatcagttttttttctttttttgttataaataatgtgcaagtgtgtttctcttgtcaaatggtaccatgttttgttgtgttattctctttgtggtaaattgtaaaccttttgttgtactttctttgccttgtttgtaagttgtaacgtctatatggagaagtcttgttcgtccaataaacaatagaacaaaaa

SEQ ID NO: 393 - DNA, 890 bp, Brassica napus
acgatcaaagaaaaactagacactactcaaaattatcttaatggcggatacacatcgcgtcgaccgtactgataggcacttgcaatttcagtcgccgtatgaaggcggacgagttagtattcagtatgaaggcggtggtggcgcaggcggctatggtggcaggggtggaggatacggtgctgaaggttacaaaagcatgatgcctgaacgtggcccatctagcacccaagtgttatcctttttggtgggggtccctatcgttggttcgctgcttgccatagccggtttacttttggcgggttcggtgataggtttactgatctctataccacttttcctcctcttcagcccggtcatagtcccagcggctctaaccatcgggcttgcagcgacaggattcttggcctctggaatgttcggtctaacggggcttagctcagtctcttgggtcctgaactaccttcgtgggaccaggaagagtagtgtgcctgagcagttggagtatgctaagaagagaatggcggatgctgttggctacgctggacagaagggaaaaggaatggggcagcacgtgcagaataaggcacaggaagctaaacagtatgatatctctaagacccatgatactactactaagggtcatgagactactcagaggacggccgcagcatgatgaagtcctgttttgagggcaagttatgtaactttcaccgtgatgtccttttacttctcctggacatttcactactacaatgttaagctcttttttgtttctaagtcaaaatcatgaaatgtagcgtctgtgtattttcatgcaagatcgcaagtggcgtacttgaatattcaataatttcttcgtacaaaaaaaaaaaaaaaaaaaaaaaaaaaaa

SEQ ID NO: 394 - DNA, 631 bp, Brassica napus
ggtgtcggagagatcataacaagaatcaatggcgaatcaaacaagaacccatcaagacataatagtccgagacagtagaattaccctagacagagaccatccgaagacaggggcgcagatggtgaaggtagcgactggtgtcgcagccggtggatccctcctagtcctctcaggcttaacactcgccggtacagtgatagcattcgctgtagccactcctctgcttattatatttagccctgtcttggtcccagcggtgatcaccgtggttctcatcatcactgggttccttgcctccggtggctttggtatagccgccataaccgccttctcttggctctacaggcacatgacggggtcaggatcggatcaaaagatagagagtgcccgaatgaaggtgggaagtagagggtatgataccaagtatgggcagcacaacattggagtccatcagcaacaccaacaagcagcttcttaaaattaatgtcagatagaactatttccacacaaattgtcatccatcgtttgatctcttttcttcgttttctcaatgcttgtgttgtaacgtaacgtgtaataataacatgtgtgtatgctgttaaaaaaaaaaaaaaaaaaaaaaaaaaaaaaa

SEQ ID NO: 395 - DNA, 655 bp, Arachis hypogaea
ttatggccggggattcgcattagcattagccctttcatttcacttcataattaattaataacatggctgaagcactctactacggcggccgccaacgccaagagcaaccaaggtccacccagcttgtcaaggccaccaccgctgttgtcgccggaggctccctcttgatcctcgccggccttgtgctggccggcaccgtcattggcctcacaacgatcacaccgctcttcgtgatcttcagcccggtgcttgtgccagctgtcatcactgtggcactcttaggcttggggttcttggcctctggaggcttcggcgtggcggcaataacagtgctgacgtggatctataggtacgtaacaggtaagcatccacctggcgccaaccaattggacacagcccgccacaagctgatgggcaaggcgcgtgagattaaggactttggtcaacaacaaaccagtggggcccaggcttcttgagcataccatcttcgtttgcatctttgtttgcacgcacgtccacgccatcatttatctttttcgaattgttatggtttattttattttatttaatttttttatgagtctggggtttccttgaaattaaccgttggtttaaaatattttccctgggttatccaatcccattcaaattttta

SEQ ID NO: 396 - DNA, 578 bp, Arachis hypogaea
ggtcacatgcatacacaaaccaaattaaatatcattccttctctttacctcttctccctgaaacctgcttcattcagagtaaaagaaacataaggaagaaaagggagcttcctgcaaccatcagccatgactgaccgtacccaaccacacgctgtccaagtccacaccacagctggccgtttcggcgacaccgctgccggaactaaccgctatgccgacagaggcccgtcaacatctaaggttatcgccgtcatcactggactccctatcggcggcacgttgctattgttcgcggggcttgcccttgccggaaccctgcttgggctggcggtgaccaccccgcttttcatcctcttcagccctgtcatagttccagccaccattgtcgttgggctctcggtggcggggttcttgacgtcaggtgcatgtgggctgacggggctgtcttcgttctcgtgggtcatgaattacatccggcagacccacggatcggtgccggagcagctggaaatggcaaagcaccgcatggctgacgtggccggttacgttggacagaagacgaaggatgtaggacagaa

SEQ ID NO: 397 - DNA, 647 bp, Arachis hypogaea
gaaaccccatcacttcttgtctaaaaattctcaaaagtcaccagccaccaaaaacccatttaccattatgtctgatcaaacaaggacaggctatggaggaggagggtcctatggatcatcctatggtggaggaggcacctatggttcatcttatggaacctcctatgaccccagtactaaccaacctatacgccaagccatcaagttcatgacagcatcaaccattggtgtctcattcttgatcctgtctgggttgatcctcactggaactgtcataggtttgatcattgcaacaccacttcttgttatcttcagtcctatccttgtccctgctgccataacccttgcactggctgctggtggatttttgttctctggtggctgtggtgttgctgccattgctgcattgtcatggttgtacagctatgtcactgggaaacaccctgctggctctgataggcttgattatgctaaaggggtgattgctgataaggctagggatgttaaggacagggccaaggattatgctggtgctggtagggctcaggagggcaccccagggtattgatcctcattgtgatgaaaaaaaatggaagcttttgtgtgtaatgtgtgggtgaagtgaaggtctgaaaggtgacaccccc

SEQ ID NO: 398 - DNA, 817 bp, Arachis hypogaea
tttttcgggatttgggggggttttttttttttttctgggaaagcgcccccttgttttggcccccggaaattggcccattagggccgggggaacaaaaggaatcccaaaaagggccttttcttttctcttaacaatcaaacaacagcaatggctactgctactgatcgtgcacctcaccaggttcaagttcacacccccaccacacaacgcgtcgacgttccacgccgcggctacgatgttagtggtggtggtattaagactcttctccccgagagaggtccgtccacctctcaaatcatcgccgtcctcgtcggcgtccccactgggggcactctgttgctcctctccggcctttcacttctcggaaccataatcgggctggcaattgccaccccggtttttatcttcttcagcccggttatagttcccgcggtcgttaccattggacttgcagtcactggtattctcacggcgggagcatgtggactaaccgggctgatgtctttgtcatggatgattaacttcatccgacaggtacatgggacgacggtgccggatcagctggactcagtgaagcggcgcatggcggacatggcggattacgtggggcagaagacaaaggatgctggccaagagatacagactaaggcccaggatgttaagaggtcatcatcataaagtaaaaaaaaaaaaaaaaaaaaaaaaaaagggggggcgccccccccccccccctatctaaaaaacaaaaaattttttgggggggggccccaaatgggttcctgggggcctaccccccaaggagaggggggaaaaaaaa

SEQ ID NO: 399 - DNA, 625 bp, Helianthus annuus
actaccaccacttacgaccgtcatttcaccaccacccaaccccactaccgccaagacgacaggtcccgctacgaccagcaaacccattcccagtccaccagcaggacactcgccatcatcgccctacttcctgtcggcggaatcttactcggcttagccgctctcacattcatcgggacgcttatcgggctcgccctcgccaccccgcttttcgtcatattcagcccgatcatcgtgccggccgttctaacaatcgggcttgctgttacaggctttttggcgtcggggacgttcgggttgacgggtttgagctcattgtcgtatttgttcaatatggttaggcagacggctgggtcggtgcccgagtccttggattatgttaaggggacgttgcaggatgccggtgagtatgccgggcagaagacgaaggatttcgggcagaagattcagagcacggctcatgagatgggtgatcaggggcaggttggtgttcatgctcaagttggtggcgggaaagaagggcgaaaaagcggtgatcggacttgaggattcaaggttgatattgtggaataataatgttgatgtaagtttttagtgttatcaaagctttgtttgtttgtttgta

SEQ ID NO: 400 - DNA, 471 bp, Zea mays
atggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcagcccggtgctggtgccggccgccatcgcgctggcgctcatggcggccgggttcgtcacctccggcggcctcggcgtcgctgcgctgtccgtgttctcctggatgtacaagtacctgacgggcaagcacccgccggccgccgaccagctggaccacgccaaggcgaggctggcgtccaaggcccgcgacgtcaaggatgcagcacagcaccgcatcgaccaggcgcaggggtcttga

SEQ ID NO: 401 - DNA, 890 bp, Brassica napus
gtttccaaacctgatgattgtagacgaatcgtcgatgagaccatctcccattttggcagattggatcatcttgtaaacaatgctggaataatgcagatttcaatgttcgaaaacattgaagaaataactaggacaagagcagttatggatactaacttttggggatcggtttatacaactcgtgctgcgcttccgtaccttcgacaaagcaatggtaagattgtggccatgtcgtcctctgcggcatggctaaccgccccaaggatgagcttttataatgctagcaaagccgcattgttgaacttcttcgagacgttgaggattgagcttggcagcgatgtacacattacaatcgtcacacctggttatattgaatctgaactcacacaaggcaagtacttctctggtgaaggcgagctagtagtcaaccaagacattagagatgttcaaattggagcatttccggtaacgtcggtatcaggttgtgccaaggggatagtgaaaggtgtgtgtaggaaacagagatacgtgaccgaaccatcgtggtttaaggtgacgtacctttggaaagtgttttgtccggaactgatcgagtggggttgcaggttgctgttcttgtccggacatggtacgtcggagaaaaatgcactcaacaagaagatcttggacatacctggtgtacgtagtgctctataccctgaatctatcagaacgccagaaatcaagtcggagtagagtgaggttgatacttaataagtgtctcatatagtggagccatgttttgtaaatggactttctattatgcacatgttactatgatgtatccgtttgtttatgtgtataagaataagtgaactttggagctccaaaaaaaaaaaaaaaaaaaaaaa

SEQ ID NO: 402 - DNA, 1266 bp, Brassica napus
ggtcgacggccattacggccgggatcccgttaatgtgtattgtgttttgatcgaagatggaattgataaacgatttcctcaatctaactgcacctttctttactttctttggtctttgcttcttcttgccccctttttatttcttcaagttcgtgcagtctatcttctcgacaattttctctgaaaacgtatatgggaaagtggttctcatcactggtgcttcctccgggatcggcgagcaattggcatatgagtacgcaagtaaaggtgcatgtttggctctgactgcccgaaggaagaaccgtctagaggaagtggcagagattgctcgtgaagttggatcccctaatgttgtcacagttcacgctgatgtttccaaacctgatgattgtagacgaatcgtcgatgagaccatctcccattttggcagattggatcatcttgtaaacaatgctggaataatgcaaatttcaatgttcgaaaacattgaagaaataactaggacaagagcagttatggatactaacttttggggagcggtttatacaactcgtgctgcgcttccgtaccttcgacaaagcaatggtaagattgtggctatgtcgtcctctgcggcatggctaaccgccccaaggatgagcttttataatgctagcaaagcagctttgttgaacttcttcgagacgttgaggattgagcttggtagcgatgtacacattacaatcgtcacacctggttatattgaatctgaactcacacaaggcaagtacgtctctggtgaaggcgagctagtagtcaaccaagacattagagatgttcaaattggagcatttccggtaacgtcagtatcaggtcgtgccaaggggatagtgaaaggtgtgtgtaggaaagagagatacgtgaccgaaccatcgtggtttaaggtgacgtacctttggaaagtgttttgtccggaactgatcgagtggggttgcagattgatgttcttgtccggacatggtacgccggaggaaaatgcactcaacaagaagatcctggacatacctggtgtacgtagtgctctataccctgaacctatcagaacgccagaaatcaagtcggagtagagtgaggttgatacttaataagtgtctcataaagtggagccatgttttgtaaatggactttctattatgcacatgttactatgatgtatctgtttgtttatgtgtataagaataagtgaactttggagctcaaaaaaaaaaaaaaaaaaaaaaaaaaaaa

SEQ ID NO: 403 - DNA, 1575 bp, Brassica napus
  misc_feature (1486)..(1488): n is a, c, g, or t
atagcctagtcccaaaaaaaactctgattgtgtcccaagtaaagagaaatggtggatctattgaactcggtgatgaatctggtggctccgccggccacgatggtggtgatggccttctcatggccattactgtgtttcattaccttctccgagcggctttataactcttattttgtgactgaagacatggaggataaagtcgtcgtcatcaccggagcttcccccgccatcggagagcaaatagcatacgaatatgcaaagaggggagcaaacttagtgttggtggcgaggagagagcaaagactgagagttgtgagcaacaacgccagacagattggagccaaccacgtcatcatcatcgctgctgatgtcgtcaaagaagatgattgccgccgtttcatcactcaagccgtcaactattacggtcgcgtggatcacctagtgaattcagcgagtcttggacacacgttttacttcgacgaagtgagtgacacgaccgtctttccgcatttgctggacataaacttctgggggaatgtctatccgacgtatgtagcgttgccacaccttcaaaagaccaatggccggatcgttgtgaacgcatcggtcgagaattggctgcctctaccgcggatgagtctttattccgctgcaaaagcggcactagtcaacttctacgagacgctgagattcgagctaaatggagatgtcggaataactatcgcgactcacgggtggatagggagtgagatgagtagaggaaagttcatgctagaagaaggtgccgagatgcagtggaaggaagaaagagaagtacctgcaaatggtggacctctagaggagtttgcaaagatgattgtggcaggagcttgcaggggagacgcatacgtgaagttcccaaactggtacgacgtgtttctcctctacagagtcttcacgccgaatgtgctgagatggacattcaagctgctgctctctagtgagggttcacgtcaaagctcccttgttggggtcgggcaaggtctgcctccagaggaatcctcttcacaaatgaaacttatgcttgaaggaggctcacctcgggtgactgctagcccacctcggtatactcccagtccaagcccacctcatcacactgctagcccacctcggtatactcccagtccaagcccacctcatcatacctcaagcccacaacggtatactcccagcccaagcccaccccattatacctcaagccgacatcgctataccccaagcccgagcccacctcattataccgaaagccctcctctgtataccgaaagtccacctcactataccacaagcccaaattggtataccgaaagccctcctcgatacaccccaagcccaagcccacctcggttttcacgttttaatatccaagagttaccataggaagtgaatggagaatcaagagtaagagtaaggatggtttggcgtgtagagtgagcttgagtttcannnctttctccaaattaggaagtcaacaaaagataaatgcaatgtaaaggacatagaatcaagaataatgcagctatgttgttacttgtc

SEQ ID NO: 404 - DNA, 1188 bp, zea mays
attgcgcacaccttgatgctgggcatgagcaggacggggttggccggagcggcgctgcgggtggcgctgacggcgctgctgccgctggtcctgccggcgtactacgtgtacaagctgaccacgtacctcctcggcgccgtcttccccgaggacgtcgccggcaaggtggtactcatcaccggcgcctcctccggcatcggcgagcacctggcctatgagtacgcgaagcggggagcctacctggcgctggtggcgaggagggaggcgagcctccgcgaggtcggcgacgtcgcgctggggctgggctcgccgggcgtcctcgtcctcccggctgacgtctccaagcctcgggactgcgagggcttcatcgacgacacgattagctacttcggtagactggatcacctggtgaacaacgcgtccatctggcaagtgtgcaagttcgaagagatccaggacgtcaggcacttgagagccctgatggacatcaacttctggggccacgtgtacccaacccggctcgccatccctcacctcaggagaagccgtggccggatcgtgggcgtcacctccaactcgtcctacatattcatcgggaggaacaccttctacaatgccagcaaggcggcggcgctcagcttctacgacaccctgaggatggagctgggcagcgacatccgcatcaccgaggtggtgccaggcgtggtggagtctgagatcaccaaggggaagatgctcaccaagggaggcgagatgaaggtggaccaggacgaaagagacgccatcctggggccgacgccggccgagcccgtgggcgacttcgccaggaccgtggtgcgcgacgtgtgccggggcgcgaggtacgtgttcgagcccaggtggtacatgggcgtctacttgctgcgggcctgcctcccggaagtcctggcctggaactcccgcctgctcactgtcgacacggtcggcgcgtccaccacggacacgctcggaaagtggctggtcgagctgcccggcgtgcgccgcgtcgtgcagccgccgtcgctccgctcgccggagatcaaggactagtgacggtgatcgtgtacgttctgtggccatggatagcactagctgtatgagaccgaagttcctttagacatcgacacgattaataaaggactcaattatcttaaaaaaaaaaaaaaaaaa

SEQ ID NO: 405 - DNA, 1022 bp, Brassica napus
attacggccggggattgcattcaatctagagaacaagaataacgagatgggtacggcgacggagataatggagagagacgcaatggctacggtggctccctacgctccggtcacttttcatcgccgtgctcgtgttgacttggatgatagacttcctaaaccatatatgccaagagccctgcaagcaccagatagagagcatccatatggaaccccaggccataagaattatggactaagtgttcttcaacaacatgtcgctttcttcgatatagatgataatggcattatctacccttgggagacctactctggactgcgaatgattggtttcaatatcattgggtcgcttatcatagctgctgtaatcaacctggcccttagctatgctactcttccgggatggttaccttcgccgttcttccctatatacatacacaacatacacaagtcaaagcatggaagcgactcaagaacatatgacaatgaagggaggtttatgccggtgaatcttgagttgatatttagcaaatatgcgaaaaccttgccagataaattgagtcttggagaattatgggacatgacagaaggacaacgtgacgcatgggacattttcggatggtttgcaagcaaaatagagtggggactgttgtacttgctagcgagggatgaagaagggtttttatcaaaagaagctattaggcggtgtttcgatgggagcttgttcgagtactgcgccaagatctacgttggtatcaatgaagacaagacagcgtactactaaagtaattgatcgagctgctttaggcttataatcgatccatatgtgttgttttgttatgtccaaatatttaaggtaaaatataagttgcagctctattaaaaagcttcaatgtggaataatagtatgttttgttgtttttctttttgtaccagcagtctctttttccatttatttccaatttaaatgcaattatgcagtgttgttgagcaaaaaaaaaaaaaaaaaaaaaaaaaaaaaa

SEQ ID NO: 406 - DNA, 1069 bp, Brassica napus
tcaattattaacacttacagaggagagagaaggagagccaaatggtaagagagagtatgggagaagagtccgaggcttttgccacgacggcgccgttagctccagtgaccggtgagcgaaaagtaaggaacgacttggaggaaacattaccaaaaccatatttggcaagagcactagtagctccagatacagagcatccgaatggatcagaaggtcatgacagcaaaggcatgagtgttacgcaacaacatgttgcttttttcgaccaaaacggcgatggaatcgtctatccttgggagacttatgcgggattccgtgacctcggtttcaacccaatctcttctgttttttgggccatattcataaactttgcgtttagctacgttacacttccgagttggttgccatcaccactattgcctgtttatatcgacaacattcacaaagccaagcatgggagtgattcaagcacctatgataccgaaggaaggtacgtcccggttaatctcgagaacatctttagcaaatatgcgttaacggctccaaataaaataacattaaaagagctttggaacttaaccgagggaaaccgaatggcaatcgatccttttggatggcttgcgaataaagttgaatggctactagtctatcttcttgcaaaggatgaggaagggttcgtgtctaaagaagctgtgagaggtgtctttgatgcaagtttctttgaatactgtgctaaaaagaataaagagaaggccgattctcgcaagcaagactaagcatttaatttgcttatcttttaaatttgtccgtttgtattattatgctctcaatcttaattaggaaaaggacagaaaacaaaactctatgtggaataaaacgtttgtgttcttggatatattgtgtgtatattgtgaataataaaatgagatttcatcattcggaaagtgaaatgatataattaaaacgaggagagagcatgaaacaatgtgtgcgcgcgctctctctagagagacaaatattagcgcggggggcgctcgtctttttttttcttaaaaaataaaaaaaaaaa

SEQ ID NO: 407 - DNA, 1030 bp, Sorghum indicum
ggcacgagagagaaaaaaggtgattttgtcaagggaaatatggcaactcatgttttggctgctgcggcggagagaaatgctgcgttggcgccggacgccccgcttgctccggtgactatggagcgcccagtgcgcactgacttggagacttcgatcccgaagccctatatggcaagaggattggttgcacctgatatggatcaccccaacggaacaccaggccatgtgcatgataatttgagtgtgctgcaacagcattgtgctttctttgatcaggatgataacggaatcatctatccatgggagacttactctggacttcgccaaattggtttcaatgtgatagcttcccttataatggctatcgtcattaatgtggcgctgagttatcctactctcccgggttggattccttctccttttttccccatatatttgtacaacatacacaaggccaaacatggaagcgactccggaacctatgatactgaaggaaggtacctacctatgaattttgagaacctgttcagcaagcatgcccggacaatgcccgataggctcactctaggggagctatggagcatgactgaagctaacagagaagcatttgacattttcggctggatcgcaagcaaaatggagtggactctcctctacattcttgcaagagaccaggacggtttcctgtcgaaagaagccatcaggcggtgttacgatggcagtttgttcgagtactgtgcaaagatgcaaaggggagccgaggacaagatgaaatgaaggaaatcggctatcgcggtaggtgtaagttatgatgtggtgtgtatgatggattgaaagtgccagtgcttaagttgtgtggcagagtcttgtgtaataacctttgtgtacagatttaaggtctcggaattggtgtaactgtggagaagatgttgactcctgtttttgttcaataagtccaactcttgacatttggttggtttgcagggaaagatggggaattttgttttccgaaaaaaaaaaaaaaaaaaaa

SEQ ID NO: 408 - DNA, 1326 bp, Zea mays
atcccagcagcaggtagcagcagcgcatgactttgtatctgcaactcgtttcgactagcctgcacgccgggagccctcgtctcgcccttctccacctccgaaggtagggtacctgatacttccctgccccgcgcatcgcatccgcggttttagtttgctggcctcggttccgatcgattcctatcctccctccgggcgggcgtccaccgacttcatcatccactcgccggccgaaccgatttgtttcgtttgccgttcgatccgcagatcctgcgagttcaacccgcgagtgagcatgtcgtcctactccccgccgccgccgccgccgcgggaccagtccatggacaccgaggcacccaacgcgcccatcaccagggagcggaggctcaaccccgatctgcaggagcagctccccaagccatatctcgcgagagctctcgaggcggtggacccgagccacccgcaggggaccaaggggcgcgacccccgcggcatgagcgtgcttcagcagcacgccgccttcttcgaccgcaatggcgacggcgtcatctacccctgggagacgtttcaaggactgcgagcgataggatgtggactcactgtatcattcgcgttctccatactgatcaacctcttcctcagttatcccactcagccgggatggttaccttctcctttgctgtccatccgtatagacaacatccacaagggtaagcacgggagtgattctgaaacctacgacactgaagggaggtttgatccatcaaagttcgatgctatattcagtaagtacggtcgaacccatcctaatgctataacaagagacgagttaagctcaatgcttcaaggaaaccgcaatacgtacgatttccttggctggttggccgctgccggtgaatggctcttactctacagcttggcgaaagacaaggatggcctcttgcagcgcgaaactgtccgtggtctatttgatgggagcctatttgagcgactggaagacgacaacaacaagaagaaatcgtcatgaatgctgagcagccttgtacagctcagggaagtgctgtcagtacaaaactaccagatataccattggtcgtgttcaaataacaaatgcttcggctttgttcatccgtcattaactatgagtgctgggatttgtttgtatgtgtgtcgtgctaccagtttcttctcctgtcgtctcacacaggtactgaattacgcatgtgttttctagtgttcgtgcggaagctgtattataagctgaaaaatgtgcgtttgaaatttatgggcaaaactgtcttcttggtcttaaaaaaaaaaaaaaaa

SEQ ID NO: 409 - DNA, 15172 bp, Artificial Sequence
  vector sequence
gcttcctcgtgctttacggtatcgccgctcccgattcgcagcgcatcgccttctatcgccttcttgacgagttcttctgaaacgcgtgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgacgtccgtacggttaaaaccaccccagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccactagacgctcaccgggctggttgccctcgccgctgggctggcggccgtctatggccctgcaaacgcgccagaaacgccgtcgaagccgtgtgcgagacaccgcagccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggcccgctctcgcgttggcagcatcacccataattgtggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcaccttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacaccccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatattggggaagaacagtatgtcgagctattttttgacttactggggatcaagcctgattgggagaaaataaaatattatattttactggatgaattgttttagtacctagatgtggcgcaacgatgctggcgacaagcaggagcgcaccgacttcttccgcatcaagtgttttggctctcaggccgaggcccacggcaagtatttgggcaaggggtcgctggtattcgtgcagggcaagattcggaataccaagtacgagaaggacggccagacggtctacgggaccgacttcattgccgataaggtggattatctggacaccaaggcaccaggcggatcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggcccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaagccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactgagatcctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttggatctcctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgctagtggatctcccagtcacgacgttgtaaaacgggcgccctagaatctaattattctattcagactaaattagtataagtatttttttaatcaataaataataattaataatttattagtaggagtgattgaatttataatatattttttttaatcatttaaagaatcttatatctttaaattgacaagagttttaaatggggagagtgttatcatatcacaagtaggattaatgtgttatagtttcacatgcattacgataagttgtgaaagataacattattatatataacaatgacaatcactagcgatcgagtagtgagagtcgtcttattacactttcttccttcgatctgtcacatggcggcggcccgaattctcacacaaggtagttgcaagacactgaagtggtggtagtggtagtagaagaagcagaatcggtagaaaggcaagacaatggagaagatgaagatggtggagattctcttcccacaacgcagcaatcaaggttttcaaggttaaggcactcgtgctttccatcatcgaacatgaagtcgatgttatcctcgaaagcaagctcgttgaagagttctgggtactcaattgggttctcgttagcaaggttttgatcggtaaggaatggggagaatccagtatccatcatgcagaagttccaagcaagttcgttgttatctccgcacctatccatttccatgatggtggaagaatcaatgcagcagttaacaacggcagcttcctcagaatatcccacaatttcagcctcttgttgctcagccttctcttcctctttttcttcttcctcttgaggtggttcctcaacgtattgttgcttaacctcttccctaggttcctctttagcttctctagtctcaacctcttgcttagcctcaacaagaataccctcttgatggttagcctggttaactgggaatgggaaaacgcccttcttcttaagcctgtcgatgtagttggagatatcgaagttggtaacagcgttagcacctctgtactcaatagcagccatatcataagcagctgcagcctcttcttgagtgttgtaagttccgaggtagaggtacttgtttccgaaaactcttccaatcctagcttcccatcttccgttatgatgatgcctagcaactcccctatacttagaaactcccctagagaatccagatgactgccttctaagggaagcaagatactcttctttggtcaccctctgcatctcttcaagttctttggtgtaagtctcagctgggaagttaagaatggtatctgggccccaatacttaagagcagcaagatcataggtatgagcagcagcctcttcagaatcataagctccaaggtaaacctgcttgcccttcttgttttggatggagttccaagaggacttatcccaaaggtgagcttcgaatcttccagtccatctatgcctagtaacacctctgtagatagatgaccttctggtagaagctggagaagttgggttatgagacttatcgccagatggagatgacttcttagccctcttagctctctttggtcttggagcttcagattgaattgggctagaggtagtagtagaagaggacactgaagaagatggagaactagagcaggtagaggtagtgagcctcttcttcatgaattctgttcttctttactctttgtgtgactgaggtttggtctagtgctttggtcatctatatataatgataacaacaatgagaacaagctttggagtgatcggagggtctaggatacatgagattcaagtggactaggatctacaccgttggattttgagtgtggatatgtgtgaggttaattttacttggtaacggccacaaaggcctaaggagaggtgttgagacccttatcggcttgaaccgctggaataatgccacgtggaagataattccatgaatcttatcgttatctatgagtgaaattgtgtgatggtggagtggtgcttgctcattttacttgcctggtggacttggccctttccttatggggaatttatattttacttactatagagctttcataccttttttttaccttggatttagttaatatataatggtatgattcatgaataaaaatgggaaatttttgaatttgtactgctaaatgcataagattaggtgaaactgtggaatatatatttttttcatttaaaagcaaaatttgccttttactagaattataaatatagaaaaatatataacattcaaataaaaatgaaaataagaactttcaaaaaacagaactatgtttaatgtgtaaagattagtcgcacatcaagtcatctgttacaatatgttacaacaagtcataagcccaacaaagttagcacgtctaaataaactaaagagtccacgaaaatattacaaatcataagcccaacaaagttattgatcaaaaaaaaaaaacgcccaacaaagctaaacaaagtccaaaaaaaacttctcaagtctccatcttcctttatgaacattgaaaactatacacaaaacaagtcagataaatctctttctgggcctgtcttcccaacctcctacatcacttccctatcggattgaatgttttacttgtaccttttccgttgcaatgatattgatagtatgtttgtgaaaactaatagggttaacaatcgaagtcatggaatatggatttggtccaagattttccgagagctttctagtagaaagcccatcaccagaaatttactagtaaaataaatcaccaattaggtttcttattatgtgccaaattcaatataattatagaggatatttcaaatgaaaacgtatgaatgttattagtaaatggtcaggtaagacattaaaaaaatcctacgtcagatattcaactttaaaaattcgatcagtgtggaattgtacaaaaatttgggatctactatatatatataatgctttacaacacttggatttttttttggaggctggaatttttaatctacatatttgttttggccatgcaccaactcattgtttagtgtaatactttgattttgtcaaatatatgtgttcgtgtatatttgtataagaatttctttgaccatatacacacacacatatatatatatatatatatattatatatcatgcacttttaattgaaaaaataatatatatatatatagtgcattttttctaacaaccatatatgttgcgattgatctgcaaaaatactgctagagtaatgaaaaatataatctattgctgaaattatctcagatgttaagattttcttaaagtaaattctttcaaattttagctaaaagtcttgtaataactaaagaataatacacaatctcgaccacggaaaaaaaacacataataaatttggggcccctagaatctaattattctattcagactaaattagtataagtatttttttaatcaataaataataattaataatttattagtaggagtgattgaatttataatatattttttttaatcatttaaagaatcttatatctttaaattgacaagagttttaaatggggagagtgttatcatatcacaagtaggattaatgtgttatagtttcacatgcattacgataagttgtgaaagataacattattatatataacaatgacaatcactagcgatcgagtagtgagagtcgtcttattacactttcttccttcgatctgtcacatggcggcggcccgcggccgcttcattactcgagccaggaggatggatcgatgctggtctgagaccctgctaccggttgctgactgaactgctcggcacggtccttcatttcacgggccttgctcgccaactttgtcttggccgactccaactgatccgctccgggtggatgtttccccgtcaggtaacggtagatccaggacagcacagacagagcggcaacaccaaatcccccgcttgccagaaaacccgctcccaacaggaagatggtgatgactgcagatcagaaaaactcagattaatcgacaaattcgatcgcacaaactagaaactaacaccagatctagatagaaatcacaaatcgaagagtaattattcgacaaaactcaaattatttgaacaaatcggatgatatctatgaaaccctaatcgagaattaagatgatatctaacgatcaaacccagaaaatcgtcttcgatctaagattaacagaatctaaaccaaagaacatatacgaaattgggatcgaacgaaaacaaaatcgaagattttgagagaataaggaacacagaaatttacctgcagggaccagtacaggcgagaagatcaccaggagaggtgtggcgattgtcagcgcaatgaccgttccagccagggtcaacccggataacaccaacaggctacctccggcagtaaccgcggtcgctgcctttacaacacgctgagcacgcggttgcagttgcaagtggggggcacgtgtttgttgctgctgcccgtagtgctctgccatggttttttttaacggagcaagcggccgctgttcttctttactctttgtgtgactgaggtttggtctagtgctttggtcatctatatataatgataacaacaatgagaacaagctttggagtgatcggagggtctaggatacatgagattcaagtggactaggatctacaccgttggattttgagtgtggatatgtgtgaggttaattttacttggtaacggccacaaaggcctaaggagaggtgttgagacccttatcggcttgaaccgctggaataatgccacgtggaagataattccatgaatcttatcgttatctatgagtgaaattgtgtgatggtggagtggtgcttgctcattttacttgcctggtggacttggccctttccttatggggaatttatattttacttactatagagctttcataccttttttttaccttggatttagttaatatataatggtatgattcatgaataaaaatgggaaatttttgaatttgtactgctaaatgcataagattaggtgaaactgtggaatatatatttttttcatttaaaagcaaaatttgccttttactagaattataaatatagaaaaatatataacattcaaataaaaatgaaaataagaactttcaaaaaacagaactatgtttaatgtgtaaagattagtcgcacatcaagtcatctgttacaatatgttacaacaagtcataagcccaacaaagttagcacgtctaaataaactaaagagtccacgaaaatattacaaatcataagcccaacaaagttattgatcaaaaaaaaaaaacgcccaacaaagctaaacaaagtccaaaaaaaacttctcaagtctccatcttcctttatgaacattgaaaactatacacaaaacaagtcagataaatctctttctgggcctgtcttcccaacctcctacatcacttccctatcggattgaatgttttacttgtaccttttccgttgcaatgatattgatagtatgtttgtgaaaactaatagggttaacaatcgaagtcatggaatatggatttggtccaagattttccgagagctttctagtagaaagcccatcaccagaaatttactagtaaaataaatcaccaattaggtttcttattatgtgccaaattcaatataattatagaggatatttcaaatgaaaacgtatgaatgttattagtaaatggtcaggtaagacattaaaaaaatcctacgtcagatattcaactttaaaaattcgatcagtgtggaattgtacaaaaatttgggatctactatatatatataatgctttacaacacttggatttttttttggaggctggaatttttaatctacatatttgttttggccatgcaccaactcattgtttagtgtaatactttgattttgtcaaatatatgtgttcgtgtatatttgtataagaatttctttgaccatatacacacacacatatatatatatatatatatattatatatcatgcacttttaattgaaaaaataatatatatatatatagtgcattttttctaacaaccatatatgttgcgattgatctgcaaaaatactgctagagtaatgaaaaatataatctattgctgaaattatctcagatgttaagattttcttaaagtaaattctttcaaattttagctaaaagtcttgtaataactaaagaataatacacaatctcgaccacggaaaaaaaacacataataaatttgggcgcgccgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctgcgatcgcatggcgattttggattctgctggcgttactacggtgacggagaacggtggcggagagttcgtcgatcttgataggcttcgtcgacggaaatcgagatcggattcttctaacggacttcttctctctggttccgataataattctccttcggatgatgttggagctcccgccgacgttagggatcggattgattccgttgttaacgatgacgctcagggaacagccaatttggccggagataataacggtggtggcgataataacggtggtggaagaggcggcggagaaggaagaggaaacgccgatgctacgtttacgtatcgaccgtcggttccagctcatcggagggcgagagagagtccacttagctccgacgcaatcttcaaacagagccatgccggattattcaacctctgtgtagtagttcttattgctgtaaacagtagactcatcatcgaaaatcttatgaagtatggttggttgatcagaacggatttctggtttagttcaagatcgctgcgagattggccgcttttcatgtgttgtatatccctttcgatctttcctttggctgcctttacggttgagaaattggtacttcagaaatacatatcagaacctgttgtcatctttcttcatattattatcaccatgacagaggttttgtatccagtttacgtcaccctaaggtgtgattctgcttttttatcaggtgtcactttgatgctcctcacttgcattgtgtggctaaagttggtttcttatgctcatactagctatgacataagatccctagccaatgcagctgataaggccaatcctgaagtctcctactacgttagcttgaagagcttggcatatttcatggtcgctcccacattgtgttatcagccaagttatccacgttctgcatgtatacggaagggttgggtggctcgtcaatttgcaaaactggtcatattcaccggattcatgggatttataatagaacaatatataaatcctattgtcaggaactcaaagcatcctttgaaaggcgatcttctatatgctattgaaagagtgttgaagctttcagttccaaatttatatgtgtggctctgcatgttctactgcttcttccacctttggttaaacatattggcagagcttctctgcttcggggatcgtgaattctacaaagattggtggaatgcaaaaagtgtgggagattactggagaatgtggaatatgcctgttcataaatggatggttcgacatatatacttcccgtgcttgcgcagcaagataccaaagacactcgccattatcattgctttcctagtctctgcagtctttcatgagctatgcatcgcagttccttgtcgtctcttcaagctatgggcttttcttgggattatgtttcaggtgcctttggtcttcatcacaaactatctacaggaaaggtttggctcaacggtggggaacatgatcttctggttcatcttctgcattttcggacaaccgatgtgtgtgcttctttattaccacgacctgatgaaccgaaaaggatcgatgtcatgagcgatcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatccctgcagggcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagatgattgaacaagatggattgcacgcaggttctccggccgcttgggtggagaggctattcggctatgactgggcacaacagacaatcggctgctctgatgccgccgtgttccggctgtcagcgcaggggaggccggttctttttgtcaagaccgacctgtccggtgccctgaatgaacttcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgactcatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgacc

SEQ ID NO: 410 - DNA, 17146 bp, Artificial Sequence
  vector sequence
gcttcctcgtgctttacggtatcgccgctcccgattcgcagcgcatcgccttctatcgccttcttgacgagttcttctgaaacgcgtgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgacgtccgtacggttaaaaccaccccagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccactagacgctcaccgggctggttgccctcgccgctgggctggcggccgtctatggccctgcaaacgcgccagaaacgccgtcgaagccgtgtgcgagacaccgcagccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggcccgctctcgcgttggcagcatcacccataattgtggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcaccttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacaccccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatattggggaagaacagtatgtcgagctattttttgacttactggggatcaagcctgattgggagaaaataaaatattatattttactggatgaattgttttagtacctagatgtggcgcaacgatgctggcgacaagcaggagcgcaccgacttcttccgcatcaagtgttttggctctcaggccgaggcccacggcaagtatttgggcaaggggtcgctggtattcgtgcagggcaagattcggaataccaagtacgagaaggacggccagacggtctacgggaccgacttcattgccgataaggtggattatctggacaccaaggcaccaggcggatcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggcccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaagccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactgagatcctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttggatctcctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgctagtggatctcccagtcacgacgttgtaaaacgggcgtctgcgatcgctgaagttcctatacttttcagagaataggaacttcggaataggaacttcccatgggatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcacgctagcggataacaatttcacacagggatatcactagtaaaaggtaccgagctcctgcagtatcgatgcggccgcaaagtcgacgaattctcattagcagaactcaagatgctgatcctctggaacgttgaacttgagcttgtgttcctcgaaaagcttgcacaactctttgatgtaacgctggtgaagtctatcaacttcctctctagaaggctgaggagtcatttgaacctcgataggctttccaacgatagtagtgataggctgtctgaaaggcatgagtccgaaagagtattggaaaactccccttccatggaaaagtggaaggctgattcccataatcttttggagtctgttctggatccatctaagccaagttccaggagtgttctcaacctggttgaagaggttgttctctccgaatgagaagataggaacaagagcagcaccatgcataagagcaagtctgatgaatcccttacggttcttcaagagaagtctgtaagcaccaggtctagcatcaagagcctcttgagcacctccaacgatgatagcaagaaggtttccaccaccctttctgctaaggatgtgatcagcagaaactttctcgctagacacgagtccaccagacatgatgtaatctctgaagaatggagccctgaaccaaacggtaagcatcataaggtaggatctgattccagggaacaaagaggtgaatccagtagactcagtacagaggttaaggaaagcaccagcagcaagaacaccatgaggatggaatccagcaatgtagttacggctaggatcaagctcagcagtcttaacgagagacacagggaagtaatccttcatgtacttccagatggccaatcttctgaagaattggataggtctaccaccttgtctaggcttatcccaatccaagtaccaccaggtagcgtaaagaacagagaaaagccagaacctggtgaacaagagtccaacgaagataacgatgcagagttgagcaagagcaaggaatgagaaaacccactgaagaacagcgaaagtctgcaatcttctctcccaaggaacaagaagtggagcgaactcgaccatgaattcagtcccccgtgttctctccaaatgaaatgaacttccttatatagaggaagggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttcaacgatggcctttcctttatcgcaatgatggcatttgtaggagccaccttccttttccactatcttcacaataaagtgacagatagctgggcaatggaatccgaggaggtttccggatattaccctttgttgaaaagtctcaattgccctttggtcttctgagactgtatctttgatatttttggagtagacaagtgtgtcgtgctccaccatgttgacgaagattttcttcttgtcattgagtcgtaagagactctgtatgaactgttcgccagtctttacggcgagttctgttaggtcctctatttgaatctttgactccatgggatccaagggccctagaatctaattattctattcagactaaattagtataagtatttttttaatcaataaataataattaataatttattagtaggagtgattgaatttataatatattttttttaatcatttaaagaatcttatatctttaaattgacaagagttttaaatggggagagtgttatcatatcacaagtaggattaatgtgttatagtttcacatgcattacgataagttgtgaaagataacattattatatataacaatgacaatcactagcgatcgagtagtgagagtcgtcttattacactttcttccttcgatctgtcacatggcggcggcccgaattctcacacaaggtagttgcaagacactgaagtggtggtagtggtagtagaagaagcagaatcggtagaaaggcaagacaatggagaagatgaagatggtggagattctcttcccacaacgcagcaatcaaggttttcaaggttaaggcactcgtgctttccatcatcgaacatgaagtcgatgttatcctcgaaagcaagctcgttgaagagttctgggtactcaattgggttctcgttagcaaggttttgatcggtaaggaatggggagaatccagtatccatcatgcagaagttccaagcaagttcgttgttatctccgcacctatccatttccatgatggtggaagaatcaatgcagcagttaacaacggcagcttcctcagaatatcccacaatttcagcctcttgttgctcagccttctcttcctctttttcttcttcctcttgaggtggttcctcaacgtattgttgcttaacctcttccctaggttcctctttagcttctctagtctcaacctcttgcttagcctcaacaagaataccctcttgatggttagcctggttaactgggaatgggaaaacgcccttcttcttaagcctgtcgatgtagttggagatatcgaagttggtaacagcgttagcacctctgtactcaatagcagccatatcataagcagctgcagcctcttcttgagtgttgtaagttccgaggtagaggtacttgtttccgaaaactcttccaatcctagcttcccatcttccgttatgatgatgcctagcaactcccctatacttagaaactcccctagagaatccagatgactgccttctaagggaagcaagatactcttctttggtcaccctctgcatctcttcaagttctttggtgtaagtctcagctgggaagttaagaatggtatctgggccccaatacttaagagcagcaagatcataggtatgagcagcagcctcttcagaatcataagctccaaggtaaacctgcttgcccttcttgttttggatggagttccaagaggacttatcccaaaggtgagcttcgaatcttccagtccatctatgcctagtaacacctctgtagatagatgaccttctggtagaagctggagaagttgggttatgagacttatcgccagatggagatgacttcttagccctcttagctctctttggtcttggagcttcagattgaattgggctagaggtagtagtagaagaggacactgaagaagatggagaactagagcaggtagaggtagtgagcctcttcttcatgaattctgttcttctttactctttgtgtgactgaggtttggtctagtgctttggtcatctatatataatgataacaacaatgagaacaagctttggagtgatcggagggtctaggatacatgagattcaagtggactaggatctacaccgttggattttgagtgtggatatgtgtgaggttaattttacttggtaacggccacaaaggcctaaggagaggtgttgagacccttatcggcttgaaccgctggaataatgccacgtggaagataattccatgaatcttatcgttatctatgagtgaaattgtgtgatggtggagtggtgcttgctcattttacttgcctggtggacttggccctttccttatggggaatttatattttacttactatagagctttcataccttttttttaccttggatttagttaatatataatggtatgattcatgaataaaaatgggaaatttttgaatttgtactgctaaatgcataagattaggtgaaactgtggaatatatatttttttcatttaaaagcaaaatttgccttttactagaattataaatatagaaaaatatataacattcaaataaaaatgaaaataagaactttcaaaaaacagaactatgtttaatgtgtaaagattagtcgcacatcaagtcatctgttacaatatgttacaacaagtcataagcccaacaaagttagcacgtctaaataaactaaagagtccacgaaaatattacaaatcataagcccaacaaagttattgatcaaaaaaaaaaaacgcccaacaaagctaaacaaagtccaaaaaaaacttctcaagtctccatcttcctttatgaacattgaaaactatacacaaaacaagtcagataaatctctttctgggcctgtcttcccaacctcctacatcacttccctatcggattgaatgttttacttgtaccttttccgttgcaatgatattgatagtatgtttgtgaaaactaatagggttaacaatcgaagtcatggaatatggatttggtccaagattttccgagagctttctagtagaaagcccatcaccagaaatttactagtaaaataaatcaccaattaggtttcttattatgtgccaaattcaatataattatagaggatatttcaaatgaaaacgtatgaatgttattagtaaatggtcaggtaagacattaaaaaaatcctacgtcagatattcaactttaaaaattcgatcagtgtggaattgtacaaaaatttgggatctactatatatatataatgctttacaacacttggatttttttttggaggctggaatttttaatctacatatttgttttggccatgcaccaactcattgtttagtgtaatactttgattttgtcaaatatatgtgttcgtgtatatttgtataagaatttctttgaccatatacacacacacatatatatatatatatatatattatatatcatgcacttttaattgaaaaaataatatatatatatatagtgcattttttctaacaaccatatatgttgcgattgatctgcaaaaatactgctagagtaatgaaaaatataatctattgctgaaattatctcagatgttaagattttcttaaagtaaattctttcaaattttagctaaaagtcttgtaataactaaagaataatacacaatctcgaccacggaaaaaaaacacataataaatttggggcccctagaatctaattattctattcagactaaattagtataagtatttttttaatcaataaataataattaataatttattagtaggagtgattgaatttataatatattttttttaatcatttaaagaatcttatatctttaaattgacaagagttttaaatggggagagtgttatcatatcacaagtaggattaatgtgttatagtttcacatgcattacgataagttgtgaaagataacattattatatataacaatgacaatcactagcgatcgagtagtgagagtcgtcttattacactttcttccttcgatctgtcacatggcggcggcccgcggccgcttcattactcgagccaggaggatggatcgatgctggtctgagaccctgctaccggttgctgactgaactgctcggcacggtccttcatttcacgggccttgctcgccaactttgtcttggccgactccaactgatccgctccgggtggatgtttccccgtcaggtaacggtagatccaggacagcacagacagagcggcaacaccaaatcccccgcttgccagaaaacccgctcccaacaggaagatggtgatgactgcagatcagaaaaactcagattaatcgacaaattcgatcgcacaaactagaaactaacaccagatctagatagaaatcacaaatcgaagagtaattattcgacaaaactcaaattatttgaacaaatcggatgatatctatgaaaccctaatcgagaattaagatgatatctaacgatcaaacccagaaaatcgtcttcgatctaagattaacagaatctaaaccaaagaacatatacgaaattgggatcgaacgaaaacaaaatcgaagattttgagagaataaggaacacagaaatttacctgcagggaccagtacaggcgagaagatcaccaggagaggtgtggcgattgtcagcgcaatgaccgttccagccagggtcaacccggataacaccaacaggctacctccggcagtaaccgcggtcgctgcctttacaacacgctgagcacgcggttgcagttgcaagtggggggcacgtgtttgttgctgctgcccgtagtgctctgccatggttttttttaacggagcaagcggccgctgttcttctttactctttgtgtgactgaggtttggtctagtgctttggtcatctatatataatgataacaacaatgagaacaagctttggagtgatcggagggtctaggatacatgagattcaagtggactaggatctacaccgttggattttgagtgtggatatgtgtgaggttaattttacttggtaacggccacaaaggcctaaggagaggtgttgagacccttatcggcttgaaccgctggaataatgccacgtggaagataattccatgaatcttatcgttatctatgagtgaaattgtgtgatggtggagtggtgcttgctcattttacttgcctggtggacttggccctttccttatggggaatttatattttacttactatagagctttcataccttttttttaccttggatttagttaatatataatggtatgattcatgaataaaaatgggaaatttttgaatttgtactgctaaatgcataagattaggtgaaactgtggaatatatatttttttcatttaaaagcaaaatttgccttttactagaattataaatatagaaaaatatataacattcaaataaaaatgaaaataagaactttcaaaaaacagaactatgtttaatgtgtaaagattagtcgcacatcaagtcatctgttacaatatgttacaacaagtcataagcccaacaaagttagcacgtctaaataaactaaagagtccacgaaaatattacaaatcataagcccaacaaagttattgatcaaaaaaaaaaaacgcccaacaaagctaaacaaagtccaaaaaaaacttctcaagtctccatcttcctttatgaacattgaaaactatacacaaaacaagtcagataaatctctttctgggcctgtcttcccaacctcctacatcacttccctatcggattgaatgttttacttgtaccttttccgttgcaatgatattgatagtatgtttgtgaaaactaatagggttaacaatcgaagtcatggaatatggatttggtccaagattttccgagagctttctagtagaaagcccatcaccagaaatttactagtaaaataaatcaccaattaggtttcttattatgtgccaaattcaatataattatagaggatatttcaaatgaaaacgtatgaatgttattagtaaatggtcaggtaagacattaaaaaaatcctacgtcagatattcaactttaaaaattcgatcagtgtggaattgtacaaaaatttgggatctactatatatatataatgctttacaacacttggatttttttttggaggctggaatttttaatctacatatttgttttggccatgcaccaactcattgtttagtgtaatactttgattttgtcaaatatatgtgttcgtgtatatttgtataagaatttctttgaccatatacacacacacatatatatatatatatatatattatatatcatgcacttttaattgaaaaaataatatatatatatatagtgcattttttctaacaaccatatatgttgcgattgatctgcaaaaatactgctagagtaatgaaaaatataatctattgctgaaattatctcagatgttaagattttcttaaagtaaattctttcaaattttagctaaaagtcttgtaataactaaagaataatacacaatctcgaccacggaaaaaaaacacataataaatttgggcgcgccgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctgcgatcgcatggcgattttggattctgctggcgttactacggtgacggagaacggtggcggagagttcgtcgatcttgataggcttcgtcgacggaaatcgagatcggattcttctaacggacttcttctctctggttccgataataattctccttcggatgatgttggagctcccgccgacgttagggatcggattgattccgttgttaacgatgacgctcagggaacagccaatttggccggagataataacggtggtggcgataataacggtggtggaagaggcggcggagaaggaagaggaaacgccgatgctacgtttacgtatcgaccgtcggttccagctcatcggagggcgagagagagtccacttagctccgacgcaatcttcaaacagagccatgccggattattcaacctctgtgtagtagttcttattgctgtaaacagtagactcatcatcgaaaatcttatgaagtatggttggttgatcagaacggatttctggtttagttcaagatcgctgcgagattggccgcttttcatgtgttgtatatccctttcgatctttcctttggctgcctttacggttgagaaattggtacttcagaaatacatatcagaacctgttgtcatctttcttcatattattatcaccatgacagaggttttgtatccagtttacgtcaccctaaggtgtgattctgcttttttatcaggtgtcactttgatgctcctcacttgcattgtgtggctaaagttggtttcttatgctcatactagctatgacataagatccctagccaatgcagctgataaggccaatcctgaagtctcctactacgttagcttgaagagcttggcatatttcatggtcgctcccacattgtgttatcagccaagttatccacgttctgcatgtatacggaagggttgggtggctcgtcaatttgcaaaactggtcatattcaccggattcatgggatttataatagaacaatatataaatcctattgtcaggaactcaaagcatcctttgaaaggcgatcttctatatgctattgaaagagtgttgaagctttcagttccaaatttatatgtgtggctctgcatgttctactgcttcttccacctttggttaaacatattggcagagcttctctgcttcggggatcgtgaattctacaaagattggtggaatgcaaaaagtgtgggagattactggagaatgtggaatatgcctgttcataaatggatggttcgacatatatacttcccgtgcttgcgcagcaagataccaaagacactcgccattatcattgctttcctagtctctgcagtctttcatgagctatgcatcgcagttccttgtcgtctcttcaagctatgggcttttcttgggattatgtttcaggtgcctttggtcttcatcacaaactatctacaggaaaggtttggctcaacggtggggaacatgatcttctggttcatcttctgcattttcggacaaccgatgtgtgtgcttctttattaccacgacctgatgaaccgaaaaggatcgatgtcatgagcgatcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatccctgcagggcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagatgattgaacaagatggattgcacgcaggttctccggccgcttgggtggagaggctattcggctatgactgggcacaacagacaatcggctgctctgatgccgccgtgttccggctgtcagcgcaggggaggccggttctttttgtcaagaccgacctgtccggtgccctgaatgaacttcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgactcatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgacc

SEQ ID NO: 411 - DNA, 11142 bp, Artificial Sequence
  TDNA sequence
tcctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgctagtggatctcccagtcacgacgttgtaaaacgggcgccctagaatctaattattctattcagactaaattagtataagtatttttttaatcaataaataataattaataatttattagtaggagtgattgaatttataatatattttttttaatcatttaaagaatcttatatctttaaattgacaagagttttaaatggggagagtgttatcatatcacaagtaggattaatgtgttatagtttcacatgcattacgataagttgtgaaagataacattattatatataacaatgacaatcactagcgatcgagtagtgagagtcgtcttattacactttcttccttcgatctgtcacatggcggcggcccgaattctcacacaaggtagttgcaagacactgaagtggtggtagtggtagtagaagaagcagaatcggtagaaaggcaagacaatggagaagatgaagatggtggagattctcttcccacaacgcagcaatcaaggttttcaaggttaaggcactcgtgctttccatcatcgaacatgaagtcgatgttatcctcgaaagcaagctcgttgaagagttctgggtactcaattgggttctcgttagcaaggttttgatcggtaaggaatggggagaatccagtatccatcatgcagaagttccaagcaagttcgttgttatctccgcacctatccatttccatgatggtggaagaatcaatgcagcagttaacaacggcagcttcctcagaatatcccacaatttcagcctcttgttgctcagccttctcttcctctttttcttcttcctcttgaggtggttcctcaacgtattgttgcttaacctcttccctaggttcctctttagcttctctagtctcaacctcttgcttagcctcaacaagaataccctcttgatggttagcctggttaactgggaatgggaaaacgcccttcttcttaagcctgtcgatgtagttggagatatcgaagttggtaacagcgttagcacctctgtactcaatagcagccatatcataagcagctgcagcctcttcttgagtgttgtaagttccgaggtagaggtacttgtttccgaaaactcttccaatcctagcttcccatcttccgttatgatgatgcctagcaactcccctatacttagaaactcccctagagaatccagatgactgccttctaagggaagcaagatactcttctttggtcaccctctgcatctcttcaagttctttggtgtaagtctcagctgggaagttaagaatggtatctgggccccaatacttaagagcagcaagatcataggtatgagcagcagcctcttcagaatcataagctccaaggtaaacctgcttgcccttcttgttttggatggagttccaagaggacttatcccaaaggtgagcttcgaatcttccagtccatctatgcctagtaacacctctgtagatagatgaccttctggtagaagctggagaagttgggttatgagacttatcgccagatggagatgacttcttagccctcttagctctctttggtcttggagcttcagattgaattgggctagaggtagtagtagaagaggacactgaagaagatggagaactagagcaggtagaggtagtgagcctcttcttcatgaattctgttcttctttactctttgtgtgactgaggtttggtctagtgctttggtcatctatatataatgataacaacaatgagaacaagctttggagtgatcggagggtctaggatacatgagattcaagtggactaggatctacaccgttggattttgagtgtggatatgtgtgaggttaattttacttggtaacggccacaaaggcctaaggagaggtgttgagacccttatcggcttgaaccgctggaataatgccacgtggaagataattccatgaatcttatcgttatctatgagtgaaattgtgtgatggtggagtggtgcttgctcattttacttgcctggtggacttggccctttccttatggggaatttatattttacttactatagagctttcataccttttttttaccttggatttagttaatatataatggtatgattcatgaataaaaatgggaaatttttgaatttgtactgctaaatgcataagattaggtgaaactgtggaatatatatttttttcatttaaaagcaaaatttgccttttactagaattataaatatagaaaaatatataacattcaaataaaaatgaaaataagaactttcaaaaaacagaactatgtttaatgtgtaaagattagtcgcacatcaagtcatctgttacaatatgttacaacaagtcataagcccaacaaagttagcacgtctaaataaactaaagagtccacgaaaatattacaaatcataagcccaacaaagttattgatcaaaaaaaaaaaacgcccaacaaagctaaacaaagtccaaaaaaaacttctcaagtctccatcttcctttatgaacattgaaaactatacacaaaacaagtcagataaatctctttctgggcctgtcttcccaacctcctacatcacttccctatcggattgaatgttttacttgtaccttttccgttgcaatgatattgatagtatgtttgtgaaaactaatagggttaacaatcgaagtcatggaatatggatttggtccaagattttccgagagctttctagtagaaagcccatcaccagaaatttactagtaaaataaatcaccaattaggtttcttattatgtgccaaattcaatataattatagaggatatttcaaatgaaaacgtatgaatgttattagtaaatggtcaggtaagacattaaaaaaatcctacgtcagatattcaactttaaaaattcgatcagtgtggaattgtacaaaaatttgggatctactatatatatataatgctttacaacacttggatttttttttggaggctggaatttttaatctacatatttgttttggccatgcaccaactcattgtttagtgtaatactttgattttgtcaaatatatgtgttcgtgtatatttgtataagaatttctttgaccatatacacacacacatatatatatatatatatatattatatatcatgcacttttaattgaaaaaataatatatatatatatagtgcattttttctaacaaccatatatgttgcgattgatctgcaaaaatactgctagagtaatgaaaaatataatctattgctgaaattatctcagatgttaagattttcttaaagtaaattctttcaaattttagctaaaagtcttgtaataactaaagaataatacacaatctcgaccacggaaaaaaaacacataataaatttggggcccctagaatctaattattctattcagactaaattagtataagtatttttttaatcaataaataataattaataatttattagtaggagtgattgaatttataatatattttttttaatcatttaaagaatcttatatctttaaattgacaagagttttaaatggggagagtgttatcatatcacaagtaggattaatgtgttatagtttcacatgcattacgataagttgtgaaagataacattattatatataacaatgacaatcactagcgatcgagtagtgagagtcgtcttattacactttcttccttcgatctgtcacatggcggcggcccgcggccgcttcattactcgagccaggaggatggatcgatgctggtctgagaccctgctaccggttgctgactgaactgctcggcacggtccttcatttcacgggccttgctcgccaactttgtcttggccgactccaactgatccgctccgggtggatgtttccccgtcaggtaacggtagatccaggacagcacagacagagcggcaacaccaaatcccccgcttgccagaaaacccgctcccaacaggaagatggtgatgactgcagatcagaaaaactcagattaatcgacaaattcgatcgcacaaactagaaactaacaccagatctagatagaaatcacaaatcgaagagtaattattcgacaaaactcaaattatttgaacaaatcggatgatatctatgaaaccctaatcgagaattaagatgatatctaacgatcaaacccagaaaatcgtcttcgatctaagattaacagaatctaaaccaaagaacatatacgaaattgggatcgaacgaaaacaaaatcgaagattttgagagaataaggaacacagaaatttacctgcagggaccagtacaggcgagaagatcaccaggagaggtgtggcgattgtcagcgcaatgaccgttccagccagggtcaacccggataacaccaacaggctacctccggcagtaaccgcggtcgctgcctttacaacacgctgagcacgcggttgcagttgcaagtggggggcacgtgtttgttgctgctgcccgtagtgctctgccatggttttttttaacggagcaagcggccgctgttcttctttactctttgtgtgactgaggtttggtctagtgctttggtcatctatatataatgataacaacaatgagaacaagctttggagtgatcggagggtctaggatacatgagattcaagtggactaggatctacaccgttggattttgagtgtggatatgtgtgaggttaattttacttggtaacggccacaaaggcctaaggagaggtgttgagacccttatcggcttgaaccgctggaataatgccacgtggaagataattccatgaatcttatcgttatctatgagtgaaattgtgtgatggtggagtggtgcttgctcattttacttgcctggtggacttggccctttccttatggggaatttatattttacttactatagagctttcataccttttttttaccttggatttagttaatatataatggtatgattcatgaataaaaatgggaaatttttgaatttgtactgctaaatgcataagattaggtgaaactgtggaatatatatttttttcatttaaaagcaaaatttgccttttactagaattataaatatagaaaaatatataacattcaaataaaaatgaaaataagaactttcaaaaaacagaactatgtttaatgtgtaaagattagtcgcacatcaagtcatctgttacaatatgttacaacaagtcataagcccaacaaagttagcacgtctaaataaactaaagagtccacgaaaatattacaaatcataagcccaacaaagttattgatcaaaaaaaaaaaacgcccaacaaagctaaacaaagtccaaaaaaaacttctcaagtctccatcttcctttatgaacattgaaaactatacacaaaacaagtcagataaatctctttctgggcctgtcttcccaacctcctacatcacttccctatcggattgaatgttttacttgtaccttttccgttgcaatgatattgatagtatgtttgtgaaaactaatagggttaacaatcgaagtcatggaatatggatttggtccaagattttccgagagctttctagtagaaagcccatcaccagaaatttactagtaaaataaatcaccaattaggtttcttattatgtgccaaattcaatataattatagaggatatttcaaatgaaaacgtatgaatgttattagtaaatggtcaggtaagacattaaaaaaatcctacgtcagatattcaactttaaaaattcgatcagtgtggaattgtacaaaaatttgggatctactatatatatataatgctttacaacacttggatttttttttggaggctggaatttttaatctacatatttgttttggccatgcaccaactcattgtttagtgtaatactttgattttgtcaaatatatgtgttcgtgtatatttgtataagaatttctttgaccatatacacacacacatatatatatatatatatatattatatatcatgcacttttaattgaaaaaataatatatatatatatagtgcattttttctaacaaccatatatgttgcgattgatctgcaaaaatactgctagagtaatgaaaaatataatctattgctgaaattatctcagatgttaagattttcttaaagtaaattctttcaaattttagctaaaagtcttgtaataactaaagaataatacacaatctcgaccacggaaaaaaaacacataataaatttgggcgcgccgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctgcgatcgcatggcgattttggattctgctggcgttactacggtgacggagaacggtggcggagagttcgtcgatcttgataggcttcgtcgacggaaatcgagatcggattcttctaacggacttcttctctctggttccgataataattctccttcggatgatgttggagctcccgccgacgttagggatcggattgattccgttgttaacgatgacgctcagggaacagccaatttggccggagataataacggtggtggcgataataacggtggtggaagaggcggcggagaaggaagaggaaacgccgatgctacgtttacgtatcgaccgtcggttccagctcatcggagggcgagagagagtccacttagctccgacgcaatcttcaaacagagccatgccggattattcaacctctgtgtagtagttcttattgctgtaaacagtagactcatcatcgaaaatcttatgaagtatggttggttgatcagaacggatttctggtttagttcaagatcgctgcgagattggccgcttttcatgtgttgtatatccctttcgatctttcctttggctgcctttacggttgagaaattggtacttcagaaatacatatcagaacctgttgtcatctttcttcatattattatcaccatgacagaggttttgtatccagtttacgtcaccctaaggtgtgattctgcttttttatcaggtgtcactttgatgctcctcacttgcattgtgtggctaaagttggtttcttatgctcatactagctatgacataagatccctagccaatgcagctgataaggccaatcctgaagtctcctactacgttagcttgaagagcttggcatatttcatggtcgctcccacattgtgttatcagccaagttatccacgttctgcatgtatacggaagggttgggtggctcgtcaatttgcaaaactggtcatattcaccggattcatgggatttataatagaacaatatataaatcctattgtcaggaactcaaagcatcctttgaaaggcgatcttctatatgctattgaaagagtgttgaagctttcagttccaaatttatatgtgtggctctgcatgttctactgcttcttccacctttggttaaacatattggcagagcttctctgcttcggggatcgtgaattctacaaagattggtggaatgcaaaaagtgtgggagattactggagaatgtggaatatgcctgttcataaatggatggttcgacatatatacttcccgtgcttgcgcagcaagataccaaagacactcgccattatcattgctttcctagtctctgcagtctttcatgagctatgcatcgcagttccttgtcgtctcttcaagctatgggcttttcttgggattatgtttcaggtgcctttggtcttcatcacaaactatctacaggaaaggtttggctcaacggtggggaacatgatcttctggttcatcttctgcattttcggacaaccgatgtgtgtgcttctttattaccacgacctgatgaaccgaaaaggatcgatgtcatgagcgatcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatccctgcagggcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagatgattgaacaagatggattgcacgcaggttctccggccgcttgggtggagaggctattcggctatgactgggcacaacagacaatcggctgctctgatgccgccgtgttccggctgtcagcgcaggggaggccggttctttttgtcaagaccgacctgtccggtgccctgaatgaacttcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgactcatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaaacgcgtgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgacgtccgtacggttaaaaccaccccagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtcc

SEQ ID NO: 412 - DNA, 13116 bp, Artificial Sequence
  TDNA sequence
tcctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgctagtggatctcccagtcacgacgttgtaaaacgggcgtctgcgatcgctgaagttcctatacttttcagagaataggaacttcggaataggaacttcccatgggatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcacgctagcggataacaatttcacacagggatatcactagtaaaaggtaccgagctcctgcagtatcgatgcggccgcaaagtcgacgaattctcattagcagaactcaagatgctgatcctctggaacgttgaacttgagcttgtgttcctcgaaaagcttgcacaactctttgatgtaacgctggtgaagtctatcaacttcctctctagaaggctgaggagtcatttgaacctcgataggctttccaacgatagtagtgataggctgtctgaaaggcatgagtccgaaagagtattggaaaactccccttccatggaaaagtggaaggctgattcccataatcttttggagtctgttctggatccatctaagccaagttccaggagtgttctcaacctggttgaagaggttgttctctccgaatgagaagataggaacaagagcagcaccatgcataagagcaagtctgatgaatcccttacggttcttcaagagaagtctgtaagcaccaggtctagcatcaagagcctcttgagcacctccaacgatgatagcaagaaggtttccaccaccctttctgctaaggatgtgatcagcagaaactttctcgctagacacgagtccaccagacatgatgtaatctctgaagaatggagccctgaaccaaacggtaagcatcataaggtaggatctgattccagggaacaaagaggtgaatccagtagactcagtacagaggttaaggaaagcaccagcagcaagaacaccatgaggatggaatccagcaatgtagttacggctaggatcaagctcagcagtcttaacgagagacacagggaagtaatccttcatgtacttccagatggccaatcttctgaagaattggataggtctaccaccttgtctaggcttatcccaatccaagtaccaccaggtagcgtaaagaacagagaaaagccagaacctggtgaacaagagtccaacgaagataacgatgcagagttgagcaagagcaaggaatgagaaaacccactgaagaacagcgaaagtctgcaatcttctctcccaaggaacaagaagtggagcgaactcgaccatgaattcagtcccccgtgttctctccaaatgaaatgaacttccttatatagaggaagggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttcaacgatggcctttcctttatcgcaatgatggcatttgtaggagccaccttccttttccactatcttcacaataaagtgacagatagctgggcaatggaatccgaggaggtttccggatattaccctttgttgaaaagtctcaattgccctttggtcttctgagactgtatctttgatatttttggagtagacaagtgtgtcgtgctccaccatgttgacgaagattttcttcttgtcattgagtcgtaagagactctgtatgaactgttcgccagtctttacggcgagttctgttaggtcctctatttgaatctttgactccatgggatccaagggccctagaatctaattattctattcagactaaattagtataagtatttttttaatcaataaataataattaataatttattagtaggagtgattgaatttataatatattttttttaatcatttaaagaatcttatatctttaaattgacaagagttttaaatggggagagtgttatcatatcacaagtaggattaatgtgttatagtttcacatgcattacgataagttgtgaaagataacattattatatataacaatgacaatcactagcgatcgagtagtgagagtcgtcttattacactttcttccttcgatctgtcacatggcggcggcccgaattctcacacaaggtagttgcaagacactgaagtggtggtagtggtagtagaagaagcagaatcggtagaaaggcaagacaatggagaagatgaagatggtggagattctcttcccacaacgcagcaatcaaggttttcaaggttaaggcactcgtgctttccatcatcgaacatgaagtcgatgttatcctcgaaagcaagctcgttgaagagttctgggtactcaattgggttctcgttagcaaggttttgatcggtaaggaatggggagaatccagtatccatcatgcagaagttccaagcaagttcgttgttatctccgcacctatccatttccatgatggtggaagaatcaatgcagcagttaacaacggcagcttcctcagaatatcccacaatttcagcctcttgttgctcagccttctcttcctctttttcttcttcctcttgaggtggttcctcaacgtattgttgcttaacctcttccctaggttcctctttagcttctctagtctcaacctcttgcttagcctcaacaagaataccctcttgatggttagcctggttaactgggaatgggaaaacgcccttcttcttaagcctgtcgatgtagttggagatatcgaagttggtaacagcgttagcacctctgtactcaatagcagccatatcataagcagctgcagcctcttcttgagtgttgtaagttccgaggtagaggtacttgtttccgaaaactcttccaatcctagcttcccatcttccgttatgatgatgcctagcaactcccctatacttagaaactcccctagagaatccagatgactgccttctaagggaagcaagatactcttctttggtcaccctctgcatctcttcaagttctttggtgtaagtctcagctgggaagttaagaatggtatctgggccccaatacttaagagcagcaagatcataggtatgagcagcagcctcttcagaatcataagctccaaggtaaacctgcttgcccttcttgttttggatggagttccaagaggacttatcccaaaggtgagcttcgaatcttccagtccatctatgcctagtaacacctctgtagatagatgaccttctggtagaagctggagaagttgggttatgagacttatcgccagatggagatgacttcttagccctcttagctctctttggtcttggagcttcagattgaattgggctagaggtagtagtagaagaggacactgaagaagatggagaactagagcaggtagaggtagtgagcctcttcttcatgaattctgttcttctttactctttgtgtgactgaggtttggtctagtgctttggtcatctatatataatgataacaacaatgagaacaagctttggagtgatcggagggtctaggatacatgagattcaagtggactaggatctacaccgttggattttgagtgtggatatgtgtgaggttaattttacttggtaacggccacaaaggcctaaggagaggtgttgagacccttatcggcttgaaccgctggaataatgccacgtggaagataattccatgaatcttatcgttatctatgagtgaaattgtgtgatggtggagtggtgcttgctcattttacttgcctggtggacttggccctttccttatggggaatttatattttacttactatagagctttcataccttttttttaccttggatttagttaatatataatggtatgattcatgaataaaaatgggaaatttttgaatttgtactgctaaatgcataagattaggtgaaactgtggaatatatatttttttcatttaaaagcaaaatttgccttttactagaattataaatatagaaaaatatataacattcaaataaaaatgaaaataagaactttcaaaaaacagaactatgtttaatgtgtaaagattagtcgcacatcaagtcatctgttacaatatgttacaacaagtcataagcccaacaaagttagcacgtctaaataaactaaagagtccacgaaaatattacaaatcataagcccaacaaagttattgatcaaaaaaaaaaaacgcccaacaaagctaaacaaagtccaaaaaaaacttctcaagtctccatcttcctttatgaacattgaaaactatacacaaaacaagtcagataaatctctttctgggcctgtcttcccaacctcctacatcacttccctatcggattgaatgttttacttgtaccttttccgttgcaatgatattgatagtatgtttgtgaaaactaatagggttaacaatcgaagtcatggaatatggatttggtccaagattttccgagagctttctagtagaaagcccatcaccagaaatttactagtaaaataaatcaccaattaggtttcttattatgtgccaaattcaatataattatagaggatatttcaaatgaaaacgtatgaatgttattagtaaatggtcaggtaagacattaaaaaaatcctacgtcagatattcaactttaaaaattcgatcagtgtggaattgtacaaaaatttgggatctactatatatatataatgctttacaacacttggatttttttttggaggctggaatttttaatctacatatttgttttggccatgcaccaactcattgtttagtgtaatactttgattttgtcaaatatatgtgttcgtgtatatttgtataagaatttctttgaccatatacacacacacatatatatatatatatatatattatatatcatgcacttttaattgaaaaaataatatatatatatatagtgcattttttctaacaaccatatatgttgcgattgatctgcaaaaatactgctagagtaatgaaaaatataatctattgctgaaattatctcagatgttaagattttcttaaagtaaattctttcaaattttagctaaaagtcttgtaataactaaagaataatacacaatctcgaccacggaaaaaaaacacataataaatttggggcccctagaatctaattattctattcagactaaattagtataagtatttttttaatcaataaataataattaataatttattagtaggagtgattgaatttataatatattttttttaatcatttaaagaatcttatatctttaaattgacaagagttttaaatggggagagtgttatcatatcacaagtaggattaatgtgttatagtttcacatgcattacgataagttgtgaaagataacattattatatataacaatgacaatcactagcgatcgagtagtgagagtcgtcttattacactttcttccttcgatctgtcacatggcggcggcccgcggccgcttcattactcgagccaggaggatggatcgatgctggtctgagaccctgctaccggttgctgactgaactgctcggcacggtccttcatttcacgggccttgctcgccaactttgtcttggccgactccaactgatccgctccgggtggatgtttccccgtcaggtaacggtagatccaggacagcacagacagagcggcaacaccaaatcccccgcttgccagaaaacccgctcccaacaggaagatggtgatgactgcagatcagaaaaactcagattaatcgacaaattcgatcgcacaaactagaaactaacaccagatctagatagaaatcacaaatcgaagagtaattattcgacaaaactcaaattatttgaacaaatcggatgatatctatgaaaccctaatcgagaattaagatgatatctaacgatcaaacccagaaaatcgtcttcgatctaagattaacagaatctaaaccaaagaacatatacgaaattgggatcgaacgaaaacaaaatcgaagattttgagagaataaggaacacagaaatttacctgcagggaccagtacaggcgagaagatcaccaggagaggtgtggcgattgtcagcgcaatgaccgttccagccagggtcaacccggataacaccaacaggctacctccggcagtaaccgcggtcgctgcctttacaacacgctgagcacgcggttgcagttgcaagtggggggcacgtgtttgttgctgctgcccgtagtgctctgccatggttttttttaacggagcaagcggccgctgttcttctttactctttgtgtgactgaggtttggtctagtgctttggtcatctatatataatgataacaacaatgagaacaagctttggagtgatcggagggtctaggatacatgagattcaagtggactaggatctacaccgttggattttgagtgtggatatgtgtgaggttaattttacttggtaacggccacaaaggcctaaggagaggtgttgagacccttatcggcttgaaccgctggaataatgccacgtggaagataattccatgaatcttatcgttatctatgagtgaaattgtgtgatggtggagtggtgcttgctcattttacttgcctggtggacttggccctttccttatggggaatttatattttacttactatagagctttcataccttttttttaccttggatttagttaatatataatggtatgattcatgaataaaaatgggaaatttttgaatttgtactgctaaatgcataagattaggtgaaactgtggaatatatatttttttcatttaaaagcaaaatttgccttttactagaattataaatatagaaaaatatataacattcaaataaaaatgaaaataagaactttcaaaaaacagaactatgtttaatgtgtaaagattagtcgcacatcaagtcatctgttacaatatgttacaacaagtcataagcccaacaaagttagcacgtctaaataaactaaagagtccacgaaaatattacaaatcataagcccaacaaagttattgatcaaaaaaaaaaaacgcccaacaaagctaaacaaagtccaaaaaaaacttctcaagtctccatcttcctttatgaacattgaaaactatacacaaaacaagtcagataaatctctttctgggcctgtcttcccaacctcctacatcacttccctatcggattgaatgttttacttgtaccttttccgttgcaatgatattgatagtatgtttgtgaaaactaatagggttaacaatcgaagtcatggaatatggatttggtccaagattttccgagagctttctagtagaaagcccatcaccagaaatttactagtaaaataaatcaccaattaggtttcttattatgtgccaaattcaatataattatagaggatatttcaaatgaaaacgtatgaatgttattagtaaatggtcaggtaagacattaaaaaaatcctacgtcagatattcaactttaaaaattcgatcagtgtggaattgtacaaaaatttgggatctactatatatatataatgctttacaacacttggatttttttttggaggctggaatttttaatctacatatttgttttggccatgcaccaactcattgtttagtgtaatactttgattttgtcaaatatatgtgttcgtgtatatttgtataagaatttctttgaccatatacacacacacatatatatatatatatatatattatatatcatgcacttttaattgaaaaaataatatatatatatatagtgcattttttctaacaaccatatatgttgcgattgatctgcaaaaatactgctagagtaatgaaaaatataatctattgctgaaattatctcagatgttaagattttcttaaagtaaattctttcaaattttagctaaaagtcttgtaataactaaagaataatacacaatctcgaccacggaaaaaaaacacataataaatttgggcgcgccgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctgcgatcgcatggcgattttggattctgctggcgttactacggtgacggagaacggtggcggagagttcgtcgatcttgataggcttcgtcgacggaaatcgagatcggattcttctaacggacttcttctctctggttccgataataattctccttcggatgatgttggagctcccgccgacgttagggatcggattgattccgttgttaacgatgacgctcagggaacagccaatttggccggagataataacggtggtggcgataataacggtggtggaagaggcggcggagaaggaagaggaaacgccgatgctacgtttacgtatcgaccgtcggttccagctcatcggagggcgagagagagtccacttagctccgacgcaatcttcaaacagagccatgccggattattcaacctctgtgtagtagttcttattgctgtaaacagtagactcatcatcgaaaatcttatgaagtatggttggttgatcagaacggatttctggtttagttcaagatcgctgcgagattggccgcttttcatgtgttgtatatccctttcgatctttcctttggctgcctttacggttgagaaattggtacttcagaaatacatatcagaacctgttgtcatctttcttcatattattatcaccatgacagaggttttgtatccagtttacgtcaccctaaggtgtgattctgcttttttatcaggtgtcactttgatgctcctcacttgcattgtgtggctaaagttggtttcttatgctcatactagctatgacataagatccctagccaatgcagctgataaggccaatcctgaagtctcctactacgttagcttgaagagcttggcatatttcatggtcgctcccacattgtgttatcagccaagttatccacgttctgcatgtatacggaagggttgggtggctcgtcaatttgcaaaactggtcatattcaccggattcatgggatttataatagaacaatatataaatcctattgtcaggaactcaaagcatcctttgaaaggcgatcttctatatgctattgaaagagtgttgaagctttcagttccaaatttatatgtgtggctctgcatgttctactgcttcttccacctttggttaaacatattggcagagcttctctgcttcggggatcgtgaattctacaaagattggtggaatgcaaaaagtgtgggagattactggagaatgtggaatatgcctgttcataaatggatggttcgacatatatacttcccgtgcttgcgcagcaagataccaaagacactcgccattatcattgctttcctagtctctgcagtctttcatgagctatgcatcgcagttccttgtcgtctcttcaagctatgggcttttcttgggattatgtttcaggtgcctttggtcttcatcacaaactatctacaggaaaggtttggctcaacggtggggaacatgatcttctggttcatcttctgcattttcggacaaccgatgtgtgtgcttctttattaccacgacctgatgaaccgaaaaggatcgatgtcatgagcgatcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatccctgcagggcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagatgattgaacaagatggattgcacgcaggttctccggccgcttgggtggagaggctattcggctatgactgggcacaacagacaatcggctgctctgatgccgccgtgttccggctgtcagcgcaggggaggccggttctttttgtcaagaccgacctgtccggtgccctgaatgaacttcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgactcatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaaacgcgtgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgacgtccgtacggttaaaaccaccccagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtcc

SEQ ID NO: 413 - DNA, 16749 bp, Artificial Sequence
  vector sequence
gcttcctcgtgctttacggtatcgccgctcccgattcgcagcgcatcgccttctatcgccttcttgacgagttcttctgaaacgcgtgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgacgtccgtacggttaaaaccaccccagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccactagacgctcaccgggctggttgccctcgccgctgggctggcggccgtctatggccctgcaaacgcgccagaaacgccgtcgaagccgtgtgcgagacaccgcagccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggcccgctctcgcgttggcagcatcacccataattgtggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcaccttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacaccccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatattggggaagaacagtatgtcgagctattttttgacttactggggatcaagcctgattgggagaaaataaaatattatattttactggatgaattgttttagtacctagatgtggcgcaacgatgctggcgacaagcaggagcgcaccgacttcttccgcatcaagtgttttggctctcaggccgaggcccacggcaagtatttgggcaaggggtcgctggtattcgtgcagggcaagattcggaataccaagtacgagaaggacggccagacggtctacgggaccgacttcattgccgataaggtggattatctggacaccaaggcaccaggcggatcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggcccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaagccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactgagatcctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttggatctcctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgctagtggatctcccagtcacgacgttgtaaaacgggcgtctgcgatcgctgaagttcctatacttttcagagaataggaacttcggaataggaacttcccatgggatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcacgctagcggataacaatttcacacagggatatcactagtaaaaggtaccgagctcctgcagtatcgatgcggccgcaaagtcgacgaattctcattagcagaactcaagatgctgatcctctggaacgttgaacttgagcttgtgttcctcgaaaagcttgcacaactctttgatgtaacgctggtgaagtctatcaacttcctctctagaaggctgaggagtcatttgaacctcgataggctttccaacgatagtagtgataggctgtctgaaaggcatgagtccgaaagagtattggaaaactccccttccatggaaaagtggaaggctgattcccataatcttttggagtctgttctggatccatctaagccaagttccaggagtgttctcaacctggttgaagaggttgttctctccgaatgagaagataggaacaagagcagcaccatgcataagagcaagtctgatgaatcccttacggttcttcaagagaagtctgtaagcaccaggtctagcatcaagagcctcttgagcacctccaacgatgatagcaagaaggtttccaccaccctttctgctaaggatgtgatcagcagaaactttctcgctagacacgagtccaccagacatgatgtaatctctgaagaatggagccctgaaccaaacggtaagcatcataaggtaggatctgattccagggaacaaagaggtgaatccagtagactcagtacagaggttaaggaaagcaccagcagcaagaacaccatgaggatggaatccagcaatgtagttacggctaggatcaagctcagcagtcttaacgagagacacagggaagtaatccttcatgtacttccagatggccaatcttctgaagaattggataggtctaccaccttgtctaggcttatcccaatccaagtaccaccaggtagcgtaaagaacagagaaaagccagaacctggtgaacaagagtccaacgaagataacgatgcagagttgagcaagagcaaggaatgagaaaacccactgaagaacagcgaaagtctgcaatcttctctcccaaggaacaagaagtggagcgaactcgaccatgaattcagtcccccgtgttctctccaaatgaaatgaacttccttatatagaggaagggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttcaacgatggcctttcctttatcgcaatgatggcatttgtaggagccaccttccttttccactatcttcacaataaagtgacagatagctgggcaatggaatccgaggaggtttccggatattaccctttgttgaaaagtctcaattgccctttggtcttctgagactgtatctttgatatttttggagtagacaagtgtgtcgtgctccaccatgttgacgaagattttcttcttgtcattgagtcgtaagagactctgtatgaactgttcgccagtctttacggcgagttctgttaggtcctctatttgaatctttgactccatgggatccaagggccctagaatctaattattctattcagactaaattagtataagtatttttttaatcaataaataataattaataatttattagtaggagtgattgaatttataatatattttttttaatcatttaaagaatcttatatctttaaattgacaagagttttaaatggggagagtgttatcatatcacaagtaggattaatgtgttatagtttcacatgcattacgataagttgtgaaagataacattattatatataacaatgacaatcactagcgatcgagtagtgagagtcgtcttattacactttcttccttcgatctgtcacatggcggcggcccgaattctcacacaaggtagttgcaagacactgaagtggtggtagtggtagtagaagaagcagaatcggtagaaaggcaagacaatggagaagatgaagatggtggagattctcttcccacaacgcagcaatcaaggttttcaaggttaaggcactcgtgctttccatcatcgaacatgaagtcgatgttatcctcgaaagcaagctcgttgaagagttctgggtactcaattgggttctcgttagcaaggttttgatcggtaaggaatggggagaatccagtatccatcatgcagaagttccaagcaagttcgttgttatctccgcacctatccatttccatgatggtggaagaatcaatgcagcagttaacaacggcagcttcctcagaatatcccacaatttcagcctcttgttgctcagccttctcttcctctttttcttcttcctcttgaggtggttcctcaacgtattgttgcttaacctcttccctaggttcctctttagcttctctagtctcaacctcttgcttagcctcaacaagaataccctcttgatggttagcctggttaactgggaatgggaaaacgcccttcttcttaagcctgtcgatgtagttggagatatcgaagttggtaacagcgttagcacctctgtactcaatagcagccatatcataagcagctgcagcctcttcttgagtgttgtaagttccgaggtagaggtacttgtttccgaaaactcttccaatcctagcttcccatcttccgttatgatgatgcctagcaactcccctatacttagaaactcccctagagaatccagatgactgccttctaagggaagcaagatactcttctttggtcaccctctgcatctcttcaagttctttggtgtaagtctcagctgggaagttaagaatggtatctgggccccaatacttaagagcagcaagatcataggtatgagcagcagcctcttcagaatcataagctccaaggtaaacctgcttgcccttcttgttttggatggagttccaagaggacttatcccaaaggtgagcttcgaatcttccagtccatctatgcctagtaacacctctgtagatagatgaccttctggtagaagctggagaagttgggttatgagacttatcgccagatggagatgacttcttagccctcttagctctctttggtcttggagcttcagattgaattgggctagaggtagtagtagaagaggacactgaagaagatggagaactagagcaggtagaggtagtgagcctcttcttcatgaattcactagtgattaaattttgttggtgctttgagcatataacaagcatggtatatataggcacgtaaacaagttgagaaattttactttgagtttgacataaccaataaaagttagtgctgtttattacctcactcagtttgcaccgcaactgtcgttagtgatgtttacctttcctttttctattatttattagtattatataatatatatatatgtgtgatgagacttgaaattgtttagcaccgcaaatgtccttcttgaggggaggttttcttttgctgaggttggggtgtcacatacacccccctctatggactcaacgtccttgctgaggtttaccccacactacatgagatttttctagactcaatactatgatatttctcgccttatcggaattggttaaactcagttgaagttagggtcatatcgataaaattgacacatgatcgactctgatattaaacagattctctccctcgaacctcactcactttcctttttctattctttattagtattatataatagatccgttccaaccattcacgtacataagaagagagatatttttttttaatggactaacatgacaaataaaacaaacaaaggagtaatgatcactacaacaaattagattatgagggacaaataatttcatcatctataaatcatgtttcgtcactaaaaattttgtgtgacgaaaaagatttcgtcaatcagttgtcactaaaaatatacaaagacgatttaatgatgtttacctttccttttctattctttattagtattatataataaatatatgtgtgatgagacttgaaattgtttagcaccgcaaatgtccttgttgaagggaggttttcttttgctgaggttggggtgtcacatacaccccctctatggactgaacgtcctttttgaggtttattttacactgcatgagatttttctagattcaacattatgatttctagactcaacactacgatcgtcactaaagactattttttatatataaaaaaaatactttgtccttaaatgtataaattagggataaatttattattataaaaaaggttaataattttgtgattaaatctattattttgtcactgaaagtgtttgcttttaccgacgacatatatgtcactaaatattatcataagtagtgacaattacaattgtcacaaaataaaaaaaattattcatattcaacaaaaaagggtactacgacaatacattttttgtcactgaaagtaatcaagttgtgataaattaatttatttaatgacaaaaatatttgtatcaaaattcacccatgatcatataataaaaataactaaaattatactaaagcataaatgacaagaaaatctaactaaaacatatcaaatattactcctaaacaaagacatataagtaaaaatttcttccaaagtatcaataacgtggtgacacatagcttgcaatcaatcttgcttcaattttcaccttttatacctgtaaaaagaaagagaaaataaaacaatgatttaaaaatcgaattcccgcggcccctagaatctaattattctattcagactaaattagtataagtatttttttaatcaataaataataattaataatttattagtaggagtgattgaatttataatatattttttttaatcatttaaagaatcttatatctttaaattgacaagagttttaaatggggagagtgttatcatatcacaagtaggattaatgtgttatagtttcacatgcattacgataagttgtgaaagataacattattatatataacaatgacaatcactagcgatcgagtagtgagagtcgtcttattacactttcttccttcgatctgtcacatggcggcggcccgcggccgcttcattactcgagccaggaggatggatcgatgctggtctgagaccctgctaccggttgctgactgaactgctcggcacggtccttcatttcacgggccttgctcgccaactttgtcttggccgactccaactgatccgctccgggtggatgtttccccgtcaggtaacggtagatccaggacagcacagacagagcggcaacaccaaatcccccgcttgccagaaaacccgctcccaacaggaagatggtgatgactgcagatcagaaaaactcagattaatcgacaaattcgatcgcacaaactagaaactaacaccagatctagatagaaatcacaaatcgaagagtaattattcgacaaaactcaaattatttgaacaaatcggatgatatctatgaaaccctaatcgagaattaagatgatatctaacgatcaaacccagaaaatcgtcttcgatctaagattaacagaatctaaaccaaagaacatatacgaaattgggatcgaacgaaaacaaaatcgaagattttgagagaataaggaacacagaaatttacctgcagggaccagtacaggcgagaagatcaccaggagaggtgtggcgattgtcagcgcaatgaccgttccagccagggtcaacccggataacaccaacaggctacctccggcagtaaccgcggtcgctgcctttacaacacgctgagcacgcggttgcagttgcaagtggggggcacgtgtttgttgctgctgcccgtagtgctctgccatggaaattttgttggtgctttgagcatataacaagcatggtatatataggcacgtaaacaagttgagaaattttactttgagtttgacataaccaataaaagttagtgctgtttattacctcactcagtttgcaccgcaactgtcgttagtgatgtttacctttcctttttctattatttattagtattatataatatatatatatgtgtgatgagacttgaaattgtttagcaccgcaaatgtccttcttgaggggaggttttcttttgctgaggttggggtgtcacatacacccccctctatggactcaacgtccttgctgaggtttaccccacactacatgagatttttctagactcaatactatgatatttctcgccttatcggaattggttaaactcagttgaagttagggtcatatcgataaaattgacacatgatcgactctgatattaaacagattctctccctcgaacctcactcactttcctttttctattctttattagtattatataatagatccgttccaaccattcacgtacataagaagagagatatttttttttaatggactaacatgacaaataaaacaaacaaaggagtaatgatcactacaacaaattagattatgagggacaaataatttcatcatctataaatcatgtttcgtcactaaaaattttgtgtgacgaaaaagatttcgtcaatcagttgtcactaaaaatatacaaagacgatttaatgatgtttacctttccttttctattctttattagtattatataataaatatatgtgtgatgagacttgaaattgtttagcaccgcaaatgtccttgttgaagggaggttttcttttgctgaggttggggtgtcacatacaccccctctatggactgaacgtcctttttgaggtttattttacactgcatgagatttttctagattcaacattatgatttctagactcaacactacgatcgtcactaaagactattttttatatataaaaaaaatactttgtccttaaatgtataaattagggataaatttattattataaaaaaggttaataattttgtgattaaatctattattttgtcactgaaagtgtttgcttttaccgacgacatatatgtcactaaatattatcataagtagtgacaattacaattgtcacaaaataaaaaaaattattcatattcaacaaaaaagggtactacgacaatacattttttgtcactgaaagtaatcaagttgtgataaattaatttatttaatgacaaaaatatttgtatcaaaattcacccatgatcatataataaaaataactaaaattatactaaagcataaatgacaagaaaatctaactaaaacatatcaaatattactcctaaacaaagacatataagtaaaaatttcttccaaagtatcaataacgtggtgacacatagcttgcaatcaatcttgcttcaattttcaccttttatacctgtaaaaagaaagagaaaataaaacaatgatttaaaggcgcgccgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctgcgatcgcatggcgattttggattctgctggcgttactacggtgacggagaacggtggcggagagttcgtcgatcttgataggcttcgtcgacggaaatcgagatcggattcttctaacggacttcttctctctggttccgataataattctccttcggatgatgttggagctcccgccgacgttagggatcggattgattccgttgttaacgatgacgctcagggaacagccaatttggccggagataataacggtggtggcgataataacggtggtggaagaggcggcggagaaggaagaggaaacgccgatgctacgtttacgtatcgaccgtcggttccagctcatcggagggcgagagagagtccacttagctccgacgcaatcttcaaacagagccatgccggattattcaacctctgtgtagtagttcttattgctgtaaacagtagactcatcatcgaaaatcttatgaagtatggttggttgatcagaacggatttctggtttagttcaagatcgctgcgagattggccgcttttcatgtgttgtatatccctttcgatctttcctttggctgcctttacggttgagaaattggtacttcagaaatacatatcagaacctgttgtcatctttcttcatattattatcaccatgacagaggttttgtatccagtttacgtcaccctaaggtgtgattctgcttttttatcaggtgtcactttgatgctcctcacttgcattgtgtggctaaagttggtttcttatgctcatactagctatgacataagatccctagccaatgcagctgataaggccaatcctgaagtctcctactacgttagcttgaagagcttggcatatttcatggtcgctcccacattgtgttatcagccaagttatccacgttctgcatgtatacggaagggttgggtggctcgtcaatttgcaaaactggtcatattcaccggattcatgggatttataatagaacaatatataaatcctattgtcaggaactcaaagcatcctttgaaaggcgatcttctatatgctattgaaagagtgttgaagctttcagttccaaatttatatgtgtggctctgcatgttctactgcttcttccacctttggttaaacatattggcagagcttctctgcttcggggatcgtgaattctacaaagattggtggaatgcaaaaagtgtgggagattactggagaatgtggaatatgcctgttcataaatggatggttcgacatatatacttcccgtgcttgcgcagcaagataccaaagacactcgccattatcattgctttcctagtctctgcagtctttcatgagctatgcatcgcagttccttgtcgtctcttcaagctatgggcttttcttgggattatgtttcaggtgcctttggtcttcatcacaaactatctacaggaaaggtttggctcaacggtggggaacatgatcttctggttcatcttctgcattttcggacaaccgatgtgtgtgcttctttattaccacgacctgatgaaccgaaaaggatcgatgtcatgagcgatcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatccctgcagggcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagatgattgaacaagatggattgcacgcaggttctccggccgcttgggtggagaggctattcggctatgactgggcacaacagacaatcggctgctctgatgccgccgtgttccggctgtcagcgcaggggaggccggttctttttgtcaagaccgacctgtccggtgccctgaatgaacttcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgactcatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgacc

SEQ ID NO: 414 - DNA, 137 bp, Artificial Sequence
  linker sequence
atttaaatgcggccgcgaattcgtcgattgaggacgtccctactagacctgctggacctcctcctgctacttactacgattctctcgctgtgcatatggtcagtcatgcccgggcctgcaggcggccgcatttaaat

SEQ ID NO: 415 - DNA, 9734 bp, Artificial Sequence
  synthesized DNA fragment
cctgcagggcgatcgcttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaatttcatatagtgttaaataataatttgttaaataaccaaaaagtcaaatatgtttactctcgtttaaataattgagattcgtccagcaaggctaaacgattgtatagatttatgacaatatttacttttttatagataaatgttatattataataaatttatatacatatattatatgttatttattattattttaaatccttcaatattttatcaaaccaactcataattttttttttatctgtaagaagcaataaaattaaatagacccactttaaggatgatccaacctttatacagagtaagagagttcaaatagtaccctttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaggttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatacttcatatgtcactcgacaaactcaagctccttgaccctgtccttggcgtagatgtccttgtacctgtcatagaggtcctgcacagcgtgcatgtaagagtcatggagctccctgatgatctcatccttggtctgaccgtacttgatagatgggactgggattggcttacccacaatggtgtaaattgggtgcctgtgtgggaggagaccaaagtcgtagttgaacacaccccttccatggaagagtggcatggtgaaaccaagagcatgctggatcttcttctgccacctgtgaagcttagagttctcattgctctcaatctgctcataaagctcattctcaccaaaggagatggtagggacaaggctagcaccagtctgcacagcaatcttgatgaaaccaaacctcctcttcaacacaaggtccatcactcctggtctggcgttcaaggactcagaggcacctcccaccacaatagcaatggaccttcctggaccacccttggtgaggatgttctggcaggaggtcttagacactgagcagagtccacaggccatgaggtaatccctgtagagtgggatgttgaagttgctggtgagggtgagcaaggaaggcctgattcctgggaagaggtcatcgaaaccagtagcgttggtggagaaggtgcagaagctacccatgctgatgataccatgtgggtggtaaccaaagatgtagttcttggatgggtcaaggtcagcctccttgataacatgagctgggaagtatccagcaaagagcttccaccaagctgcgttcctgagccacctgataggtctgcctccgttctcaggggccttatcccacaccaaaatccaggtcaagtagaggataattgggaaccaaaggagcacagggatgctgcagaggaagaagaagatgaacatgcagatgctcatcatggagcaccagaggagaacagcaagggtttggagccttctcctaagtgggaccctgagtggagcatacctaggggatgggatggcctcaagggtgtgcttcaccttctgttggaggtgctggtccttgctagccatatggtaattgtaaatgtaattgtaatgttgtttgttgtttgttgttgttggtaattgttgtaaaaagtatatcttaaattctttaatacggtgtactaggatattgaactggttcttgatgatgaaaacctgggccgagattgcagctatttatagtcataggtcttgttaacatgcatggacatttggccacggggtggcatgcagtttgacgggtgttgaaataaacaaaaatgaggtggcggaagagaatacgagtttgaggttgggttagaaacaacaaatgtgagggctcatgatgggttgagttggtgaatgttttgggctgctcgattgacacctttgtgagtacgtgttgttgtgcatggcttttggggtccagtttttttttcttgacgcggcgatcctgatcagctagtggataagtgatgtccactgtgtgtgattgcgtttttgtttgaattttatgaacttagacattgctatgcaaaggatactctcattgtgttttgtcttcttttgttccttggctttttcttatgatccaagagactagtcagtgttgtggcattcgagactaccaagattaattatgatgggggaaggataagtaactgattagtacggactgttaccaaattaattaataagcggcaaatgaagggcatggatgcgatcgcgcggccgctcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagctaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagaattcttttacaacaattaccaacaacaacaaacaacaaacaacattacaattacatttacaattaccaaatgaagaagaggctcactacctctacctgctctagttctccatcttcttcagtgtcctcttctactactacctctagcccaattcaatctgaagctccaagaccaaagagagctaagagggctaagaagtcatctccatctggcgataagtctcataacccaacttctccagcttctaccagaaggtcatctatctacagaggtgttactaggcatagatggactggaagattcgaagctcacctttgggataagtcctcttggaactccatccaaaacaagaagggcaagcaggtttaccttggagcttatgattctgaagaggctgctgctcatacctatgatcttgctgctcttaagtattggggcccagataccattcttaacttcccagctgagacttacaccaaagaacttgaagagatgcagagggtgaccaaagaagagtatcttgcttcccttagaaggcagtcatctggattctctaggggagtttctaagtataggggagttgctaggcatcatcataacggaagatgggaagctaggattggaagagttttcggaaacaagtacctctacctcggaacttacaacactcaagaagaggctgcagctgcttatgatatggctgctattgagtacagaggtgctaacgctgttaccaacttcgatatctccaactacatcgacaggcttaagaagaagggcgttttcccattcccagttaaccaggctaaccatcaagagggtattcttgttgaggctaagcaagaggttgagactagagaagctaaagaggaacctagggaagaggttaagcaacaatacgttgaggaaccacctcaagaggaagaagaaaaagaggaagagaaggctgagcaacaagaggctgaaattgtgggatattctgaggaagctgccgttgttaactgctgcattgattcttccaccatcatggaaatggataggtgcggagataacaacgaacttgcttggaacttctgcatgatggatactggattctccccattccttaccgatcaaaaccttgctaacgagaacccaattgagtacccagaactcttcaacgagcttgctttcgaggataacatcgacttcatgttcgatgatggaaagcacgagtgccttaaccttgaaaaccttgattgctgcgttgtgggaagagaatctccaccatcttcatcttctccattgtcttgcctttctaccgattctgcttcttctactaccactaccaccacttcagtgtcttgcaactaccttgtgtgagaattcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccggtctagaggatccaaggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgcgcggccgcatttaaatcatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactctcgagttttacaacaattaccaacaacaacaaacaacaaacaacattacaattacatttacaattaccaaatggtcgagttcgctccacttcttgttccttgggagagaagattgcagactttcgctgttcttcagtgggttttctcattccttgctcttgctcaactctgcatcgttatcttcgttggactcttgttcaccaggttctggcttttctctgttctttacgctacctggtggtacttggattgggataagcctagacaaggtggtagacctatccaattcttcagaagattggccatctggaagtacatgaaggattacttccctgtgtctctcgttaagactgctgagcttgatcctagccgtaactacattgctggattccatcctcatggtgttcttgctgctggtgctttccttaacctctgtactgagtctactggattcacctctttgttccctggaatcagatcctaccttatgatgcttaccgtttggttcagggctccattcttcagagattacatcatgtctggtggactcgtgtctagcgagaaagtttctgctgatcacatccttagcagaaagggtggtggaaaccttcttgctatcatcgttggaggtgctcaagaggctcttgatgctagacctggtgcttacagacttctcttgaagaaccgtaagggattcatcagacttgctcttatgcatggtgctgctcttgttcctatcttctcattcggagagaacaacctcttcaaccaggttgagaacactcctggaacttggcttagatggatccagaacagactccaaaagattatgggaatcagccttccacttttccatggaaggggagttttccaatactctttcggactcatgcctttcagacagcctatcactactatcgttggaaagcctatcgaggttcaaatgactcctcagccttctagagaggaagttgatagacttcaccagcgttacatcaaagagttgtgcaagcttttcgaggaacacaagctcaagttcaacgttccagaggatcagcatcttgagttctgctaatgactcgagaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaaatttaaatcctgcagg

SEQ ID NO: 416 - DNA, 10374 bp, Artificial Sequence
  synthesized DNA fragment
ttaattaataatgtataagcattaaattaaagatactagaatcaattttgtaattataaacgtaattaaatcttaaatcttcgaggttagaccttcaggaaatagagatgcttgcagaagatcccgacgtctgcgatcgcgacgtcctagaatctaattattctattcagactaaattagtataagtatttttttaatcaataaataataattaataatttattagtaggagtgattgaatttataatatattttttttaatcatttaaagaatcttatatctttaaattgacaagagttttaaatggggagagtgttatcatatgacaagtaggattaatgtgttatagtttcacatgcattacgataagttgtgaaagataacattattatatataacaatgacaatcactagcgatcgagtagtgagagtcgtcttattacactttcttccttcgatctgtcacatggcggcggcccgaattctcatcaccaccactcgaaatcattgaaggacacctgatcatcagaggagcccacgtaagcatgatcctctggagtcatagaagaggtggcctggtggtgctgaagatcagtagtgagatccatgaggtcgtttgggattgggtagtggtcgttaaggttgccgatgagcatagcaatggaggcctcttcttcatctcttgggatgtagtcgagcatggcctcttcgtaatgattcctctcacgagactcgttctcacgaccctcattctgcttaccggagtttccgttcatggcgaagtagaggttcttggactcgtcctcatagatagtgaggaagtcgccgatctcagcaccgttttgcttcacgaactcaccagtgttctcgagcacgtacatcctggacttgttgttggaccagaacttgtacttgaaggaccaggactgcatagagaacacgtccctcatctgaacgacgatgccctctttgtcagagagctttggaaggttggcctcagcatctctctttggaagcacaattcttccgagggatcccacatcggagttcttgagttctttctcgcagagcaccctgagtttcttgttgtcgaaagtggactgctggtaggagtccttcttgtcggagatctgcacgttgttcttgaggttgagcatcatgagctgcctcttagaatccacaagctcggatggtgaagagtttggggaggagttgttacgggacctcatcatggcgttcttacggttgatcctggccatcttagtcatccttgggtcaagaaatcctcccctctcttgccaaaggcatgggtttccaacaagagatccgaactcggatccagtctgagtcactggaatctgtgggtagcactctgagaggtacactggctgtggattcataacagcagccatctgctcaacggggtaagagaatggtggaaggaagtgatgaggctgagcctggtgatgatcgtaagttggcacagtagtgaagtgggacctgttgttgttggggtccatggaaagctcttgcacagagttagcgttggaggatgggaatgggaggaagttgtccatggtgaattcgctagcggttgatgatgttggtgagactgagaaccttgggggtctttatatagatgttcagctatgcggggatgcgatcctggggtaggagagcacgtacggggccccgctcgtttgtggctctccgtgcggacatcccgtgcggacagtaccagaaagtgctccgtctctgctctatacggctctatacgcgtacctcttgaacggtgcgtggagaggagtggtgtgtcaatttccgccccgccctcgtgcggttccgcatgcatccaatcctaggtcggaactatcccgagctgcggatgccgatgcggacggacaagtgggaactatcacaactatcgagacgtcgcccgttcgactcagatcttccaaggcctcgtctccgagtccgctgcttctcgccgcgccgatcacttctccgccgccaacaaggcttgtagttaataggaatcattcagggattgtgattccgggcagtagtaattaataatatagtattagtatagataatatgtttcgtttgggatctttggaacgttgctctgttccttgttgttcattttaaagcttttgagggatagttgcagaactgttcggtgatgcttcatcctctcaagaactagatttgggtaaagaaacatccatgcatggatatggaatgttgttcttccgattggagattattttataaaatttaaaattcatgatttaaaaaaacacataaaaaccacaaaattcatgatttattgacaatacgatacaaaattagcaccaccggctactggctcattacacatttccccttcccctcattctcactttgtggctttattattattattattacatatattttaccgttattatttcacgtcacataagcttgactagtttagaggaagctgtcgacctttccgttgagtcccctctcaagatccttagccacgagagcagccatatcagacttacggccaaggaactggagagccctgatgcagtagttgcagttctgcctaagttgaaggtatccagcgagagcgtttccctgaccatcaagatcaaggcaatcgaggaggatgtaagcagccttagcaaatgagtggatgagcaccacagtccatggctcaacaaggaatgcaacctcagtaagggagtcgtggaagtgcctgtacattggagaagccttgcctggatcgagttcttggcctctaagagatgacctagcgagagcagacacagcaagagcgttatcaagcctgagcttagtcacgaggtcgatgtggttgatatcggagtaggaatccctgtcgatggactcgagcacatcagccaaaagcatagcagcaaggtgccagtgtccatcaaggatcacgtaccaagactggatcctggatgggagaagctcatggttggcaacgcaatcctgcatgaatggctggtacttagcagtccagtggttgtacacgtagagagtcctctgaatagcagcctcaagcctagctggagaagctcccctatacaacaaagtctggagctgagtcacacgcctgtaaagcaacaccttaacaggagtagcagaggagagagcagcagcagcttgttcataagtgcatggccacctagcagctggttgagaaatttgagtgtgggactcgtggtcgggcaaagaatcagaagtcctaaggaacaggtcgccccacacatcagacttctcttgattagatgggacctgccttggtggctcccagcaatcaaggttaataggagtctcggcacctcttcttggtggagaagcagaagagatctgggagtcctcatcggacacaacaagtggcctctggtacatagcagcagacagagtgtcgaacatgatcccgagccagaacatgagagacagagtagacctgtgttcctcagaagccaccactggatcaagttgtggagactcagatgagggggtgggagtctcgaaaattccagcgaaagtagaagccacggatccaccaggaagcctattgaaagccttaccccttctctgcatcctagcgaacttgtgcctgaaggtgtagagctgcctattagcagtctcgaggaacactggagcaccatcattctcgagaagcttatcgagcctagctcccattccatgttgctcatcatcatcgagcacggactgagtgaggctgaagatgatgttggcgaagatcaccctgaaggatgggattccagtagtgtgctgaagtgcatgcctagcctcattccaagcgttacgcctaatagaacgctcgtcagcagcaatatcagctgggacgttaagtccagctcccctttgagcatgttgagtccactgagaagcgaaagccacaatagcaaggtgaagtgccctagcagcagccttatcttcttcagcggagagagcccttcctctaagagaagttgacaccctatcgagcctgcacaccctaatgcacatcctgttagaccaatttggtccccactcagccctttgctttggtgggaggtaagaaatctggtcggagtatgggcagttgtgctcagtaagccagcaagaaagggcgttttccatggagtcgtggtagatcctcatgaggttcttggtcatggtggacctagcataccttctagcggtagagtcggaagccatgcacaaactgttttctgggaggagtggagactgcctatcagaccaaagagagccatcctgagcaacttgctgaacggagttagtgtcagtcacggaatctggatcggtagtctgttcctcaagctcacgaatgagatcatcagtgtttggggagtgtggtggaagaagaacagcctggaaagacaatggggagaggggcttctcaagttgctgtcccatagagaaatcgcctgggatagcaagatcccatgggaatggagcatcagattgcacgttagcagcatcctcagcgttagctggaatagcagaatgggagaagtcgaagagatcgccagggtgagaaagaagtccctgagtccaagatggcaaagcatcgtgggagttgatcactggtggagcatcgtgattatcggactcgggagttggaatagtagcagcggaagtagaaggctcggaggtagtagtagcagtcctagccttcttagtcctagctcttggagcagcacccttagccttagacctttgggagctaagccagttgaaggtgcagtccttgttccacctcttgcagttagagcatgacacccatccgttctcattagcctcgttacggttctctggagcatcacatcttctcttgcccttacggcatgggtcacaagagtggttctgccttcttctagtgtcggccatggtactagtactcattattaaaacaaacataaacatattattataaaaactaaaaacattacaaacttacaaatttctctgaagttgtatcctcagtacttcaaagaaaatagcttacaccaaattttttcttgttttcacaaatgccgaacttggttccttatataggaaaactcaagggcaaaaatgacacggaaaaatataaaaggataagtagtgggggataagattcctttgtgataaggttactttccgcccttacattttccaccttacatgtgtcctctatgtctctttcacaatcaccgaccttatcttcttcttttcattgttgtcgtcagtgcttacgtcttcaagattcttttcttcgcctggttcttctttttcaatttctacgtattcttcttcgtattctggcagtataggatcttgtatctgtacattcttcatttttgaacataggttgcatatgtgccgcatattgatctgcttcttgctgagctcacataatacttccatagtttttcccgtaaacattggattcttgatgctacatcttggcccgggtcgatagttgtgatagttcccacttgtccgtccgcatcggcatccgcagctcgggatagttccgacctaggattggatgcatgcggaaccgcacgagggcggggcggaaattgacacaccactcctctccacgcaccgttcaagaggtacgcgtatagagccgtatagagcagagacggagcactttctggtactgtccgcacgggatgtccgcacggagagccacaaacgagcggggccccgtacgtgctctcctaccccaggatcgcatccccgcatagctgaacatctatataaagacccccaaggttctcagtctcaccaacatcatcaaccgctagcgggcccaccatgaagaagcgactcactacctccacttgctccagctctccatcttcctctgtgtcctcttccactaccacctctagcccaattcaatctgaggctccaagacctaagagggccaagagagctaagaaatcctctccatccggcgacaagtctcacaacccaacttctccagcttccacccgtaggtcatctatctacagaggtgttactaggcacaggtggactggaaggtttgaggctcatctctgggacaagtccagctggaactccatccaaaacaagaagggcaagcaggtttacctcggcgcttacgattctgaagaggctgctgctcacacttacgatcttgctgctcttaagtactgggggccagacactattctcaacttcccagctgagacttacaccaaagaactcgaagagatgcagagggtgaccaaagaagagtacctcgcttctctcaggcgtcagtcatctggattttctaggggcgtgtcaaagtacaggggagttgctaggcatcatcacaatggaagatgggaggctaggatcggaagggtgttcggaaacaagtacctctacctcggcacctacaacacccaagaagaggcagctgctgcttacgacatggctgctattgagtacaggggtgctaacgctgtgaccaacttcgacatctccaactacatcgacaggctcaagaaaaagggcgtgttcccattcccagtgaaccaggctaatcaccaagagggaatcctcgtcgaagctaagcaagaggttgagactcgtgaggccaaagaggaacctagggaagaggttaagcagcagtacgttgaggaaccacctcaagaagaggaagaaaaagaggaagagaaggccgagcaacaagaggctgagattgtgggatattccgaagaggccgctgttgtgaactgctgcatcgactcctccaccatcatggaaatggataggtgcggcgacaacaacgagcttgcttggaatttctgcatgatggacaccggcttctccccattccttactgatcagaacctcgccaacgagaacccaattgagtaccccgagcttttcaacgagctggctttcgaggataacatcgacttcatgttcgacgacggaaagcacgagtgccttaaccttgagaacctcgattgctgtgtggtgggaagagaatccccaccctcttcatcttcaccactcagctgcctttctaccgactccgcttcttccactactactaccactacctccgtgtcctgcaactacctcgtgtaagggcccgccgccatgtgacagatcgaaggaagaaagtgtaataagacgactctcactactcgatcgctagtgattgtcattgttatatataataatgttatctttcacaacttatcgtaatgcatgtgaaactataacacattaatcctacttgtcatatgataacactctccccatttaaaactcttgtcaatttaaagatataagattctttaaatgattaaaaaaaatatattataaattcaatcactcctactaataaattattaattattatttattgattaaaaaaatacttatactaatttagtctgaatagaataattagattctagcccgggcctgcaggcatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggacttctagaaccatggctatcctcgactccgctggtgtgactactgttactgaaaatggtggtggcgagttcgtggatcttgatagacttaggcgtaggaagtccaggtccgattcttctaacggacttctcctctccggctccgataacaactctccatctgatgatgttggggctccagctgatgtgagggataggattgattccgtggtgaacgatgatgctcagggcactgctaatctcgctggtgataacaatggtggcggagataacaacggtggtggaagaggtggtggtgagggaagaggtaatgctgacgctactttcacctacaggccatctgttccagctcatagaagggctagagagagccctctttcctccgatgctatcttcaagcagtctcacgctggactcttcaacctttgcgtggtggtgcttatcgctgtgaactccaggctcattatcgagaacctgatgaagtacggctggctcatcaggaccgatttctggttctctagccgttctcttagggactggccactctttatgtgctgcatctccctcagcattttcccactcgctgctttcactgttgagaagcttgtgctccagaagtacatctctgagcccgtggtgattttcctccacatcatcatcaccatgaccgaggtgctctacccagtgtacgttacacttaggtgcgactccgctttcctctctggtgtgactcttatgctcctcacttgcatcgtgtggctcaagcttgtttcctacgctcacacctcctacgacattcgttctcttgctaacgctgccgacaaggctaatcccgaagtgtcttactacgtgtcccttaagtccctcgcctactttatggtggctccaactctttgctaccagccatcttatccaaggtccgcctgtattaggaagggatgggttgcaaggcagttcgctaagctcgtgatcttcactggattcatgggcttcattatcgagcagtacatcaaccccatcgtgaggaactctaagcaccctcttaagggcgatctcctctacgctattgagagggtgttgaagctctctgtgccaaacctttacgtgtggctctgcatgttctactgctttttccacctctggctcaatatcctcgctgagcttctttgcttcggcgacagagagttctacaaggattggtggaacgctaagtccgtgggcgattattggaggatgtggaacatgccagtgcacaagtggatggtgaggcacatctactttccatgcctcaggtccaagatcccaaagaccctcgctatcattatcgcattcctcgtgtctgctgtgttccacgagttgtgcattgctgttccatgccgacttttcaagctctgggctttcctcggaatcatgttccaggttccactcgtgttcatcaccaactacctccaagagaggttcggctccactgttggcaacatgattttctggttcatcttctgcatcttcggccagccaatgtgcgtgttgttgtactaccacgacctcatgaaccgtaagggctccatgtcttaatctagaaggggtgatcgattatgagatcgtacaaagacactgctaggtgttaaggatggataataataataataatgagatgaatgtgttttaagttagtgtaacagctgtaataaagagagagagagagagagagagagagagagagagagagagagagagagagaggctgatgaaatgttatgtatgtttcttggtttttaaaataaatgaaagcacatgctcgtgtggttctatcgaattattcggcggttcctgtgggaaaaagtccagaagggccgccgcagctactactacaaccaaggccgtggaggagggcaacagagccagcacttcgatagctgctgcgatgatcttaagcaattgaggagcgagtgcacatgcaggggactggagcgtgcaatcggccagatgaggcaggacatccagcagcagggacagcagcaggaagttgagaggtggtcccatcaatctaaacaagtcgctagggaccttccgggacagtgcggcacccagcctagccgatgccagctccaggggcagcagcagtctgcatggttttgaagtggtgatcgatgagatcgtataaagacactgctaggtgttaaggatgggataataagatgtgttttaagtcattaaccgtaataaaaagagagagaggctgatggaatgttatgtatgtatgtttcttggtttttaaaattaaatggaaagcacatgctcgtgtgggttctatctgcaggcggccgcggcgcc

SEQ ID NO: 417 - DNA, 434 bp, Artificial Sequence
  hpRNAi
gtgagcaatgaaccaagatttatcaataccgttacttttgatagcaaagagggttctcctactcttgttatggtccacggatatggtgcctctcagggtttcttctttcggaatttttatgcccttgcgaggcatttcaaagttattgctattgatcagcttggctggggtggttcaagcaggcctgacttcacatgcagaagtacagaagagactgaagattggtttattgattcctttgaggagtggcgcaaagccaaaaaccttagcaactttattttgcttgggcactcctttggagggtatgtcgctgcaaaatatgctctcaagcatccagagcatgttcagcagttgattctggtaggaccagctggatttacatcagagactgaacatatgtccgagcggcttacccagtttagagcaacatggaa

SEQ ID NO: 418 - DNA, 593 bp, Artificial Sequence
  hpRNAi
actgctgatgctgtcaggcagtatctatggttgtttgaggagcataatgttcttgaattcctcgtacttgctggagatcatctatatcgaatggattatgaaaagttcattcaagcccacagagaaacagatgctgatattactgttgccgcactgccaatggatgaaaagcgagccactgcatttggtctcatgaagattgacgaagaaggacgcattattgaatttgcagagaaaccgaaaggagagcaattgaaagcaatgaaagtggatactaccattttaggtcttgatgatgagagagctaaagagatgccttttatcgcaagtatgggtatatatgtcattagcaaagatgtgatgttaaacttacttcgtgataagttccctggtgccaatgattttggcagtgaagttattcctggtgcaacttcgcttgggatgagagtgcaagcttatttatatgatggatactgggaagatattggtaccatcgaagctttctacaatgccaatttgggcattaccaaaaagccagtcccagattttagcttctatgaccgatcagctccaatctacacccaacctcgata

SEQ ID NO: 419 - protein, 5 aa, Artificial Sequence
  lipase motif
  misc_feature (2)..(2): Xaa can be any naturally occurring amino acid
  misc_feature (4)..(4): Xaa can be any naturally occurring amino acid
GXSXG

SEQ ID NO: 420 - protein, 6 aa, Artificial Sequence
  acyltransferase motif
  X (2)..(5): any amino acid
HXXXXD

SEQ ID NO: 421 - protein, 7 aa, Artificial Sequence
  probable lipid binding motif
  X (2)..(4): any amino acid
VXXXHGF

SEQ ID NO: 422 - DNA, 1224 bp, Arabidopsis thaliana
atggcggaagaaatctcaaagacgaaggtgggatcttcttctactgcttcggtggctgattcatctgctgctgcgtcggctgcaacgaatgcggccaaatcaagatggaaaattttgtggcctaattcgctccggtggattcctacgtccaccgattacatcatcgccgccgagaaacgtcttctctccatcctcaagacgccttatgtacaagagcaagtcagtattggttcaggaccaccaggttctaaaatcaggtggtttaggtctacgagcaatgagtcacgttacatcaacactgttacatttgatgccaaggagggagctcctacactcgtcatggttcatggttatggtgcttctcaagggtttttcttccgtaattttgatgctcttgccagtcgatttagagtgatcgctattgatcaacttgggtggggtggttcaagtaggcctgattttacatgtagaagcacagaagaaactgaggcatggtttatcgactcctttgaggaatggcgtaaagcccagaatctcagtaactttattctattaggacattcttttggaggctatgttgctgctaaatacgcgcttaagcatcctgaacatgttcaacacttaattctggtgggatctgctgggttctcagcagaagcagatgccaaatcagaatggctcactaaatttagagcaacatggaaaggtgcagtcctaaatcatttatgggagtcaaatttcactcctcagaagctggttagaggattaggtccttggggtccaggtcttgtaaatcggtatacaactgcaagatttggtgcacattcggagggaactgggctaacagaagaggaagccaaattgctaaccgattatgtgtaccatactttggctgcaaaggctagtggagagttatgcttgaaatacatcttctcatttggagcatttgctaggaagcccctcttacaaagtgcatcagagtggaaagtgccaacaacgtttatctatggaatgaatgattggatgaactatcaaggtgcggtggaagcgaggaaatccatgaaggtcccttgcgaaatcattcgggttccacagggtggtcattttgtgttcatagacaacccaattggttttcattctgcagtgctttatgcttgccgcaagtttatatctcaagactcctctcatgatcaacaactcctagatggtctacgattggtttag

SEQ ID NO: 423 - DNA, 1700 bp, Brachypodium distachyon
tccgcgcccgaaacgatcccaacagaagctctaatctccaaagccgccgcgcgtgttgagggtggtgcggggaaaagcttggtgtcgtgagcccccgtgtcgcatgcgccgcgctgccgccgtgacgaggatggcagcgaccgaggagatgaggcaggcgtccgccgccgccgccgccacggtgaccgaggcctcggcgtcggcggccccgcccgcggggtccaggtgggcgcgggtgtggccggccgcgctgcgctggatccccacctccaccgagcgcatcatcgccgccgagaagcgcctcctctccgtactcaaaactgggtatgtccaagaacaagttaacattggctcggctccacccgggtcaaaagtaagatggtttagatcatcaagtgatgagccaaggttcatcaatacagtgacatttgatagcaaggagaatgctcccactcttgtcatggtccatggttatggtgcttcacagggtttcttctttagaaattttgatgcccttgcaagccgtttccgagtgattgccattgatcagcttggttggggtggatcaagtagacctgacttcacctgtaaaagtaccgaagaaactgaggcttggttcatagattctttagaggaatggcgtaaagcaaagaacctcagtaattttatattgctcggtcattctttcggaggatatgttgcagcaaaatatgccttgcagcatcctgaacacgtgcagcacttaattttggtcggttctgctgggttttcatcagaaacagatcatagctctgagtggttaaccaagtttcgagcaacatggaaaggcatgctagtgaaccaactatgggagtccaattttactcctcaaagaattgtaagaggattgggtccttggggcccagatttggttcgcagatataccactgctaggtttggctcatattcaacaggtgaattactaacagaacatgagtccggcttgctgacagattacatttaccatacattagctgccaaagctagtggagagctgtgcttgaaatatattttttccttgggggcatttgcaaggaaacctcttctgcagagtgcatctgactggaaagtgccgaccactttcatatatggccatgacgattggatgaaataccagggggcacagcaagcacgcaaggatatgaaagttccttgcgaaatcatcagagtcccacagggaggacattttgtgttcatagataacccttccgggttccattcggcagtcttctatgcgtgccggaaatttttatctggagatgcagaggagggtctctctcttcctgatggcctgatatctgcatgacagcatgaggcgcgatgtcataccaattagcggtatgaacacaaagcaaagctatacggagctaggaaatgttacaaatgtcacgactcaccagaaatgttacaaatgtcaccactcaccagtttcctttttgtatgtatgaattgtgtgaatatacacgtcattcatatttgccggcgtatcagtacttcaatagtgataaaacatgatcatatatatatgtatgatttctctagtcggttctcatcaagtcaagttattgtgattggtgaatgatatactttccaggtcaactttgtgtttgcatgtacaaactatcatggaacatatcagtatagtttatgatttgtcttcc

SEQ ID NO: 424 - DNA, 1484 bp, Glycine max
gtcatggatgcgcgtcactgctcgcgttcattataatggcggaagagataaccaagaacgacgtcggagtaacctccaaaaccaccagaagcagctccaggttctggcctcgttggattcccacttccaccgatcacatcatcgctgccgagaagcgccttctttccgtcgtcaagactggttatgttcaagagcatgttaacattggctctggtcctcctggctccaaagtgaggtggttccgttcatccagcaacgagccgcggtttattaacaccgttacatttgacagtaaaccccattctccaacgcttgtcatgattcatggttatgctgcttcacaggggttcttttttcgcaattttgacgcgcttgcgtctcgatttagagtcattgctgttgatcaacttggatggggtggatcgagcagacctgatttcacatgcaaaagcactgaagaaactgaggcatggtttattgattcttttgaggaatggagaaaagccaaaaacttgagcaattttatactgctcggacattcttttggtggttatgttgctgccaaatatgcgctcaagcaccctgagcatgtacaacacttgattctggttggatctgctggattttcatctgaatcagatgcaaagtctgagtggataacaaggtttcgagcaacatggaagggggcagttttgaaccatctttgggaatcaaatttcacacctcagaaacttgtcaggggtttaggtccttggggtcccaacatagtccgcaagtatacaagtgctaggtttggtacacattcaactggggaaatactgactgaagaggaatcaacattgctgacagactatgtttaccacacattggcggccaaagctagtggagagctgtgcttaaaatatattttttcatttggagcatttgctaggatgccccttcttctcagtgcctcagagtggaaggtgcccaccactttcatgtatggtttccaagactggatgaattatcaaggtgcccaagaagctcgcaagcatatgaaggttccatgcgaaatcatcaggattcctcagggtgggcactttgcgttcattgacaacccaactgccttccattcagctgttttttatgcttgtcgaaggtttcttacacctgatccagacaatgaatctcttcctaaagggctaacctctgcataggttaggtcttaattttgtgctattcctgtctatatgtattttaatatttttttttactaattaaatttcataattgaatgaaatcatatgtatattgtttcagtaaagtggaatttactgaaaatatttgtaatagcaacttcaacaaaaatcgatttgtaggagaaatttcttccctggaaattgttctattttaaatcttgttgctcataagatattatgacttcattcaactaataattcatgtcgtttaggaaaagtagttagttatattaaatttgtcaa

SEQ ID NO: 425 - DNA, 1662 bp, Zea mays
accatacgggcggggccgcaccgaccgaacctaaccgagagcacgagcatacccgtcccgactccgactgcagagcatcagccgaggagaaaagtcgggagaaacgcgcgtgacgtctgcccgcgtcgtatgcgccgcgctgccgtcgccgcgacgacgacgacgaccaggatggcagccgaggagatgagacgggcctccgcctcaacggccacggcggagatgccggcgtcgccggcgccggcgcaagcggggtcgaggtgggcgcgggtgtggccgcgcgcgctccggtggatccccacctccacggaccgcatcatcgccgccgagaagcgactcctcacgatagtcaaaactggatatgtccaggaacgagtcaacattggctctgctccacctgggtcaaaagtaagatggtttaggtcagcaagtgatgaaccaaggttcattaatactgtaacatttgatagcaaggagaatgcccccaccctggttatggtccatggctatggagcttcacaggggttcttctttcgaaactttgatgcccttgcaagccgttttagggtgattgccattgatcagcttggctggggtggttcaagcagacctgacttcacatgtaaaagtaccgaagaaactgaggcatggttcatagattctttcgaggagtggcgcaaggccaagaacctcagtaattttatattgcttggtcactcttttggaggatatgttgctgcaaaatatgcgctaaagcaccctgaacacgttcaacagttgattttggttggtcctgctggcttctcatcagaaacagagcatagctctgagtggttaaccaagtttcgagcaacatggaaaggcatgctaatgaatcgtctttgggagtccaattttactccccaaagggttattaggggattgggtccttggggtccaggtctagtacagagatataccagtgccaggtttggtacaagttctactggtgaattactaacagatgaagaatcggcattgatgacagattatatgtaccatacgttagctgccaaagctagtggagagctgtgcttgaaatatatattttccttcggggcatttgcaaggaaacctcttctgcagtgcgcgtccgattggaaagtgccgactactttcatatatgggcagcaagattggatgaactaccaaggcgctcagcaagcacggaaggacatgaaagttccttgtgaaataatcagggtgccgcagggtggacattttgtgttcatagacaacccttcagggttccactcggctgtcttctatgcgtgccgtaatcttctatcagtaaatggagaggagggattcacatttcctgatggcctaatatctgcgtgaagtggcatgttcaacaagcttgctcaacaacagtttacataaagcaaagatatacgattgtggaaatcattgcccatttccaccaatttgcttgtatacggattatgctgtgtatatattacataacaaatgtattagtatcatttaatgcacgatttgtgaaagggcctgagtttgtatttagcgaattttaggttggtttttttccctttttcttctttcagtgcgcttgctagtcaatcccatactataagccgtgatcatttaaaaaaaaaaaaaaaa

SEQ ID NO: 426 - DNA, 1763 bp, Sorghum bicolor
actgcagatgcgcggtcgtcggctccggctcgcggaggcgagaacggcgaaccagcccgtgtctctgttccctttcttccctttaaaaacacggcaaaaaaaaagctagccggttacgctaccgaaccgaacggctcggcacgcgggcacgggcgcggggtcgcaccggaaaagcacgagcagagcagacctgacgtctccagactgcaggagcatcatcagtcgaggaggaggaagtgtgggggggggaaagggaaacgtgcgcgtcgtatgcgcctcgctgccgtcgccaggacgaccaggatggcagccgaggagatgaggcgggcctcggcctccgcggcggtcgcggccacgacggaggcggcgccggcgccggcgcaagcggggtccaggtgggcgcgggtgtggccgagcgcgctccggtggatccccacctccacggatcgcatcatcgccgcggagaagcggctcctctcgatagtcaaaactgggtatgtccaggaacaagtcaacattggctcagctccacctgggtcaaaagtaagatggtttaggtcagcgagtgatgaaccaaggttcattaatactgtaacatttgatggcaaggagaacgcccccaccctggttatggtccatggctatggagcttcacaggggttcttctttcgaaactttgacgcccttgcaagtcgttttagggtgattgccattgatcagcttggctggggtggttcaagcagacctgacttcacatgtaaaagtaccgaagaaactgaggcatggttcatagattcttttgaggagtggcgcaaggccaagaacctcagtaattttatattgcttggtcactcctttggaggatatgttgcggcaaagtatgccctaaagcaccctgaacacattcagcacttagttttggttggtcctgctggcttctcgtcagaaacagaccatagctctgagtggttaaccaagtttcgagcaacatggaaaggcatgctagtgaatcatctttgggagtccaattttactccccaaagagttattagaggattgggcccttggggtccaggtctagtacaaagatataccagtgccaggtttggtacacgttcaactggtgatatactaacagatcaagaatcaacattgttgacagattatatttaccataccttagctgccaaagctagtggagagctgtgcttgaaatatatattttccttcggggcatttgcaaggaaacctcttctgcagtgcgcatccgattggaaagtgccgactactttcatatatggtcaggaagattggatgaactaccaaggggctcagcaagcacggaaggacatgaaagttccttgtgaaataatcagggtgccacagagtggacattttgtgtttatagacaacccttcagggttccactcggctgtcttctacgcgtgccgtaatcttttatcccaaaatggggaggagggcttcacatttcctggtggcctaatatctgcatgaagtggcatgttcaacaatcttatcgtgcccaacaatagtttatatgaagcaaagatatacgatggtggaaatctttgctcatttccaccaatctggaaatatttgtgccctcttccaccaatttgtttgtatacggattatgccgtgtatatattctgtgttgactgtaagaaacataatgtattaacattatgtaatgtatgtacgattctttatttgattttcaacttgcaatacgcaagaaccac

SEQ ID NO: 427 - DNA, 1399 bp, Ricinus communis
cgcctttttaccagtcaatttccatttttatatataagtgcttttgcttaatttaagactaactacagcgacgaattcgcgtttatgaaattgcttcgcctacgactgctacgagtatctagctcctcaatatcatcaataatggcggaaggggctgctgccacatcagcatcagcatcagcgtcagcgtcagcgtcatgggcaaaaacaagatctctacggccatctgctctccgttggatcccaacttcaaccgatcacatcatcgccgccgaaaagcgtcttctctccctcgtcaagactccctatgttgtggaacaagtgaatatagggtctggcccaccggggtcgaaggtgaggtggtttcgttctaaaagcgacgaggcacggtttattaacacggttacttttgatagcaaagaggaggattctcctacactggttatggttcatggatatgctgcttctcaaggcttcttctttcgcaattttgatgctcttgcttctcgtttcaggctcattgctattgatcagctcggttggggtggatcaagtagacctgattttacgtgtaagagcactgaagaaactgaggcatggttcattgactcctttgaggcttggcgtaaagagaaaaacctcagtaacttcatcttacttggacattctttcggagggtatattgcagctaaatatgcactcaagcatcctgagcatgttcaacatctgattttagtgggatctgctggattttcatcagaatctgaagacaaatctgagcagcttactcggttcagagcaacatggaagggagcagttttgaatcatttatgggagtctaattttactcctcagaaggttattagaggtttaggtccttggggtccagatctcgtacgcaagtacacaactgctagatttggttcatattcaactggtgagatattaaaggaggaggagtccaaattgcttacagactatgtgtaccataccttagccgccaaagctagtggagagctatgcttgaaatatatattttcttttggagcatttgctcggatgccccttctacaaagcgcgtcacaatggaaagtgccaactactttcatatatgggatgcaagattggatgaattatcaaggggcccaaagagctcgcaaagatatgaatgtcccatgtgaaatcattagggttcctcagggcgggcacttcgttttcatagacaacccaactgggtttcattcagctgtgttatatgcctgccggagatttctctcacccgatcctgataatgaatctcttcctgaaggtctgatatctgcgtaggaagtgtggtttgtaattatttcttttttatttgttgtgtataatttatctgagaatttccaattctttcaat

SEQ ID NO: 428 - DNA, 1480 bp, Medicago truncatula
ggttggctcatagttccttttacctgttgaaaacaaaacatatggagtaacattttagtcagaaattcaaagctacgcacttgattaaactaattatcgaaaaatggcggaagaaattagacaaaaggacgacgtcgattcatcttcgaaatctaaaagcttctggtcttcactccgttggattcccacttctaccgatcatatcatcgccgctgagaaacgccttctttccattatcaagactgggtatgctcaagagcatgttaatataggttctggtcctcctggctctaaagttagatggttccgttcaaccagtaacgagccacgctttctcaacactgttacatttgatagtaaacccgattctcctacacttgttatggttcatggatacgctgcttctcagggtttcttctttcgcaattttgatgctctcgcctctcgtttcagaatcattgctgttgatcaacttggttggggaggatcaagcagacctgatttcacatgcaaaagtaccgaagaaactgaggcatggttcattgattctttcgaggaatggagaaaagccaaaaatcttaccaatttcatactgcttggacattcttttggtggttatgttgcttccaaatacgcgctcaagcaccctcagcacgtacaacacttaattttggtgggacctgccgggtttacagaagaaacagatccaaagactgagtttgttactaagtttcgagcaacatggaagggagcagttctgaaccatctatgggaatctaattttacacctcagaaaattgtcagaggtttaggtccttggggtcctaacatggtccgcaaatatacaagtgctaggtttggtacacattcaaccgggcaaaaactgattgacgaggaatcaagtctgctgactgattatgtttatcatacattggcggccaaagctagtggggagctgtgtttaaaatatatttttgcatttggagcatttgctaggatgccccttcttcaaagtgctcaagagtggaaggtgcccaccacattcatatatggttacgaagattggatgaattatgaaggtgcccaagaagctcgcaagcatatgaaggttccatgtgaaattatcagggtccctaaggccggccattttgtgttcattgacaacccaagtggcttccattcagctgtgttttatgcttgtcgaaggtttcttaccccaaattcggacaatgaatctcttcccgaagggctatcgtctgcttaggatttaattttgcatcaatccagtgtatattaatatggttattaatttttttttacttcataactgaatgaagccgtgtcttgtttctcagtgaagtggaatataatggaaatatatgtaattgtaataacaataatattgatttgttggggaactttgaggacaaaaacatattctggtaaaattttgttgcacatgcgacaaacatatgctgtg

SEQ ID NO: 429 - protein, 407 aa, Arabidopsis thaliana
MAEEISKTKVGSSSTASVADSSAAASAATNAAKSRWKILWPNSLRWIPTSTDYIIAAEKRLLSILKTPYVQEQVSIGSGPPGSKIRWFRSTSNESRYINTVTFDAKEGAPTLVMVHGYGASQGFFFRNFDALASRFRVIAIDQLGWGGSSRPDFTCRSTEETEAWFIDSFEEWRKAQNLSNFILLGHSFGGYVAAKYALKHPEHVQHLILVGSAGFSAEADAKSEWLTKFRATWKGAVLNHLWESNFTPQKLVRGLGPWGPGLVNRYTTARFGAHSEGTGLTEEEAKLLTDYVYHTLAAKASGELCLKYIFSFGAFARKPLLQSASEWKVPTTFIYGMNDWMNYQGAVEARKSMKVPCEIIRVPQGGHFVFIDNPIGFHSAVLYACRKFISQDSSHDQQLLDGLRLV

SEQ ID NO: 430 - protein, 413 aa, Brachypodium distachyon
MRRAAAVTRMAATEEMRQASAAAAATVTEASASAAPPAGSRWARVWPAALRWIPTSTERIIAAEKRLLSVLKTGYVQEQVNIGSAPPGSKVRWFRSSSDEPRFINTVTFDSKENAPTLVMVHGYGASQGFFFRNFDALASRFRVIAIDQLGWGGSSRPDFTCKSTEETEAWFIDSLEEWRKAKNLSNFILLGHSFGGYVAAKYALQHPEHVQHLILVGSAGFSSETDHSSEWLTKFRATWKGMLVNQLWESNFTPQRIVRGLGPWGPDLVRRYTTARFGSYSTGELLTEHESGLLTDYIYHTLAAKASGELCLKYIFSLGAFARKPLLQSASDWKVPTTFIYGHDDWMKYQGAQQARKDMKVPCEIIRVPQGGHFVFIDNPSGFHSAVFYACRKFLSGDAEEGLSLPDGLISA

SEQ ID NO: 431 - protein, 387 aa, Glycine max
MAEEITKNDVGVTSKTTRSSSRFWPRWIPTSTDHIIAAEKRLLSVVKTGYVQEHVNIGSGPPGSKVRWFRSSSNEPRFINTVTFDSKPHSPTLVMIHGYAASQGFFFRNFDALASRFRVIAVDQLGWGGSSRPDFTCKSTEETEAWFIDSFEEWRKAKNLSNFILLGHSFGGYVAAKYALKHPEHVQHLILVGSAGFSSESDAKSEWITRFRATWKGAVLNHLWESNFTPQKLVRGLGPWGPNIVRKYTSARFGTHSTGEILTEEESTLLTDYVYHTLAAKASGELCLKYIFSFGAFARMPLLLSASEWKVPTTFMYGFQDWMNYQGAQEARKHMKVPCEIIRIPQGGHFAFIDNPTAFHSAVFYACRRFLTPDPDNESLPKGLTSA

SEQ ID NO: 432 - protein, 416 aa, Zea mays
MRRAAVAATTTTTRMAAEEMRRASASTATAEMPASPAPAQAGSRWARVWPRALRWIPTSTDRIIAAEKRLLTIVKTGYVQERVNIGSAPPGSKVRWFRSASDEPRFINTVTFDSKENAPTLVMVHGYGASQGFFFRNFDALASRFRVIAIDQLGWGGSSRPDFTCKSTEETEAWFIDSFEEWRKAKNLSNFILLGHSFGGYVAAKYALKHPEHVQQLILVGPAGFSSETEHSSEWLTKFRATWKGMLMNRLWESNFTPQRVIRGLGPWGPGLVQRYTSARFGTSSTGELLTDEESALMTDYMYHTLAAKASGELCLKYIFSFGAFARKPLLQCASDWKVPTTFIYGQQDWMNYQGAQQARKDMKVPCEIIRVPQGGHFVFIDNPSGFHSAVFYACRNLLSVNGEEGFTFPDGLISA

SEQ ID NO: 433 - protein, 414 aa, Sorghum bicolor
MRLAAVARTTRMAAEEMRRASASAAVAATTEAAPAPAQAGSRWARVWPSALRWIPTSTDRIIAAEKRLLSIVKTGYVQEQVNIGSAPPGSKVRWFRSASDEPRFINTVTFDGKENAPTLVMVHGYGASQGFFFRNFDALASRFRVIAIDQLGWGGSSRPDFTCKSTEETEAWFIDSFEEWRKAKNLSNFILLGHSFGGYVAAKYALKHPEHIQHLVLVGPAGFSSETDHSSEWLTKFRATWKGMLVNHLWESNFTPQRVIRGLGPWGPGLVQRYTSARFGTRSTGDILTDQESTLLTDYIYHTLAAKASGELCLKYIFSFGAFARKPLLQCASDWKVPTTFIYGQEDWMNYQGAQQARKDMKVPCEIIRVPQSGHFVFIDNPSGFHSAVFYACRNLLSQNGEEGFTFPGGLISA

SEQ ID NO: 434 - protein, 413 aa, Ricinus communis
MKLLRLRLLRVSSSSISSIMAEGAAATSASASASASASWAKTRSLRPSALRWIPTSTDHIIAAEKRLLSLVKTPYVVEQVNIGSGPPGSKVRWFRSKSDEARFINTVTFDSKEEDSPTLVMVHGYAASQGFFFRNFDALASRFRLIAIDQLGWGGSSRPDFTCKSTEETEAWFIDSFEAWRKEKNLSNFILLGHSFGGYIAAKYALKHPEHVQHLILVGSAGFSSESEDKSEQLTRFRATWKGAVLNHLWESNFTPQKVIRGLGPWGPDLVRKYTTARFGSYSTGEILKEEESKLLTDYVYHTLAAKASGELCLKYIFSFGAFARMPLLQSASQWKVPTTFIYGMQDWMNYQGAQRARKDMNVPCEIIRVPQGGHFVFIDNPTGFHSAVLYACRRFLSPDPDNESLPEGLISA

SEQ ID NO: 435 - protein, 386 aa, Medicago truncatula
MAEEIRQKDDVDSSSKSKSFWSSLRWIPTSTDHIIAAEKRLLSIIKTGYAQEHVNIGSGPPGSKVRWFRSTSNEPRFLNTVTFDSKPDSPTLVMVHGYAASQGFFFRNFDALASRFRIIAVDQLGWGGSSRPDFTCKSTEETEAWFIDSFEEWRKAKNLTNFILLGHSFGGYVASKYALKHPQHVQHLILVGPAGFTEETDPKTEFVTKFRATWKGAVLNHLWESNFTPQKIVRGLGPWGPNMVRKYTSARFGTHSTGQKLIDEESSLLTDYVYHTLAAKASGELCLKYIFAFGAFARMPLLQSAQEWKVPTTFIYGYEDWMNYEGAQEARKHMKVPCEIIRVPKAGHFVFIDNPSGFHSAVFYACRRFLTPNSDNESLPEGLSSA

SEQ ID NO: 436 - protein, 371 aa, Oryza sativa
MAAEGMSTAAAAAEATATAAPAAGSRWGRAWPSALRWIPTSTDRIIAAEKRLLSIVKTGYVQEQVNIGSSPPGSKVRWFRSSSDEPRFINTVTFDSEENAPTLVMVHGYGASQGFFFRNFDALASRFRVIAIDQLGWGGSSRPDFTCKSTEETEAWFIDSFEEWRKAKNLSNFILLGHSFGGYVAAKYALQHPEHVQHLILVGPAGFSSETEHSSEWLTKFRATWKGMLVNHLWESNFTPQRIVRGLGPWGPGLVQRYTSARFGSHSTGELLTEQESTLLTDYIYHTLAAKASGELCLKHIFSFGAFARKPLLQRSYEHPGDLESICTIGGHFVFIDNPSGFHSAVFHACRKFLSGDGEEGLSLPEGLTSA

SEQ ID NO: 437 - DNA, 1317 bp, Arabidopsis thaliana
gatctctctccctctctctctctctctctccgggaaaaatggataacttcttaccctttccctcttctaacgcaaactctgtccaagaactctctatggatcctaacaacaatcgctcgcacttcacaacagtccctacttatgatcatcatcaggctcagcctcatcacttcttgcctccgttttcatacccggtggagcagatggcggcggtgatgaatcctcagccggtttacttatcggagtgttatcctcagatcccggttacgcaaaccggaagtgaattcggttctctggttggtaatccttgtttgtggcaagagagaggtggttttcttgatccgcgtatgacgaagatggcaaggatcaacaggaaaaacgccatgatgagatcaagaaacaactctagccctaattctagtccaagtgagttggttgattcaaagagacagctgatgatgcttaacttgaaaaataacgtgcagatctccgacaagaaagatagctaccaacagtccacatttgataacaagaagcttagggttttgtgtgagaaggaattgaagaacagcgatgttgggtcactcgggaggatagttctaccaaagagagatgcagaagcaaatcttccgaagctatctgataaagaaggaatcgttgtacagatgagagatgttttctctatgcagtcttggtctttcaaatacaagttttggtccaataacaagagcagaatgtatgtcctcgagaacacaggagaatttgtgaagcaaaatggagctgagataggagactttttaacaatatacgaggacgaaagcaagaatctctacttcgccatgaatggaaattcgggaaaacaaaatgaaggaagagaaaatgagtcgagggaaaggaaccactacgaagaggcaatgcttgattacataccaagagacgaagaggaagcttccattgcaatgctcatcggaaatctaaacgatcactatcccatccctaacgatctcatggacctcaccactgaccttcagcaccatcaagccacgtcctcatcaatgccacctgaggatcacgcgtacgtgggttcatccgatgatcaggtgagctttaacgactttgagtggtggtgatatggtggtggaagttctcaagttcataaccccctttatgaaaatagaccttaagatatacaaaagagattaaaagaaaaaaaagttagtatatttcatcatatctctcattgaagatgagatttatatctataattgtttaatagtgtttttattacttttctatcaatatattaaagttttaatt

SEQ ID NO: 438 - DNA, 1439 bp, Medicago truncatula
tttcatccttacatattttgcatattgaaacacgtaggatggaataagattgataacaaaaattgcattgtttgcatattgaaaacatgggacaattgcatgggttcatgtgcttcattataagccacacattaggaaacacaggttgatattcaccactatttaacataagaatatctcatgtgtaagcattcatacaaatatcacaattgaattaaaaaccaaagaaatgtcttcctctaacttctcttgtatcctatccatctccttaacattcttcatcttgctactgaacaaggtgaattcagcagaaacaacttccttttccatcacaaaatttgtcccagatcaaaagaatctcatcttccaaggcgatgcgaaaactgcctcaacagggaagttagaactctccaaggcagtcaagaactctattggtagagctctttattccgcccctattcacatttgggatagcaaaaccggtagtgtggctaactttcaaactaccttcacctttacaataacggcgcctaatacttataatgttgcagacggtcttgcattcttcattgcaccaattgatactaagccgaaatcaattcatcatggaggataccttggagttttcgatagcaaaacttacaaaaaatcaattcaaactgttgcagttgaaattgacactttctataatgctcaatgggatccaaatcccggaaatataagtagcactggtcgacatattggaatcgatgtaaactctatcaaatcaataagcaccgtgccgtggagtttggaaaacaataaaaaggctaatgttgcgatagggtttaatggtgcaacaaatgtgttgagtgttgatgtggaatatcctttgattcgtcattataccctaagtcatgttgtgcctttgaaggatgttgttcctgagtgggtaaggattggtttctcttcttctactggagccgaatattcagcacatgatattttatcgtggtcttttgattcaaagttgaacctaggttttgagaacaatatcaatgccaatgtttcaagctctactcaagctgcatagttgaaaacttatccattatgtatgtgtgagtgtaaccaaccagtctaagaaaactataataagatacctgaaataatggttcattatcgtgtagtagaaatatggtcacaccatatcttcttttttttttaataaattatggaataatgctatttctcgcgagagttatgtttcggaaagattcatgaatagatgttaatcaattagatctatatatatatatatatatatatatatatatatatatatagcattttcttaaattatgcatatgtaatatcgtgtaatgctattgtttatatcaatgaatggtgttttgtagtcacataattcgtaatttctctccatgagaacagcgaaccaatta

SEQ ID NO: 439 - DNA, 1393 bp, Brassica napus
gagatgggtatccctataaggtgcagcatcgaaccatctgcaacattttgactcgttttcttttgtgtttttataacatctgtctcttcttcactcgatctccctctcttttctttttcaatctccccaacgaacctcccttcataactctctttctctccccgggaaatatggataacttcttgcccttttcctcttctaacgcaaactctgtccaagaactctccatggatcttaacaagaatcgctcgcacttctccatggcgcagcctcagcacttgttgccgccttactcgtacgttgcatgtccggcacttgatcagacggggaccatgaatcatcagcctcttcactcatcggatgcttttcctcagatcccggttgtacaaaccggaggtgaattcggctatttggtttgtaagcccggtgtgaggcaggaacgaggtggatttcttgatccacactccactaagatggctaggatcaacaggaagaaggcgatgctaagatcaagaaacaactctaaccctaattctagttcgaatgagttggttgattcaaggagacaagtggctcttaccatgaaaaataatgccgagattgctgctagaaaagatttttatcgattctcctcattcgataacaagaaacttagggttttgttggtgaagcacttgaagaacagcgatgttgggtcacttggaaggattgttctaccaaagagagaagcagaaggaaatcttccggagctatctgataaagaaggaatggtattagagatgagagatgttgactctgtgcagtcttggtctttcaaatacaagtactggtccaataacaagagcagaatgtatgtcctcgaaaacacaggagaatttgtgaagaaaaatggagtattgatgggagactatctaacaatctacgaggacgaaagcaagaatctctacttctccatcagaaagcacccacacaaacaaaatgatggaagagaggatgagtcgatggaagttatcgagatgaacttctatgaagatataatgtttgattacataccaaatgatgaagacgattccattgcaatgctcctcggaaatctaaacgagcactatccctacccaaatgatcttatggatctcactgtcaatcttgatcagcatcagcaagccacctcctcgtcgccacctgctgatcacatgagctcgaacgatttcttatggtgatgtgatggacgttgatatggattccctttgagatgatatacaagggatgaaaagaaaagagtatcatattcatatccatatttgtttgataaaatgtgtttgttcccaatctattatttatgaaaaacttatttgtgtttaactccagattaattaaatatttttcatttgac

SEQ ID NO: 440 - DNA, 1755 bp, Arabidopsis thaliana
atgaactcgatgaataactggttaggcttctctctctctcctcatgatcaaaatcatcaccgtacggatgttgactcctccaccaccagaaccgccgtagatgttgccggagggtactgttttgatctggccgctccctccgatgaatcttctgccgttcaaacatcttttctttctcctttcggtgtcaccctcgaagctttcaccagagacaataatagtcactcccgagattgggacatcaatggtggtgcatgcaataacattaacaataacgaacaaaatggaccaaagcttgagaatttcctcggccgcaccaccacgatttacaataccaacgagaccgttgtagatggaaatggcgattgtggaggaggagacggtggtggtggcggctcactaggcctttcgatgataaaaacatggctgagtaatcattcggttgctaatgctaatcatcaagacaatggtaacggtgcacgaggcttgtccctctctatgaattcatctactagtgatagcaacaactacaacaacaatgatgatgtcgtccaagagaagactattgttgatgtcgtagaaactacaccgaagaaaactattgagagttttggacaaaggacgtctatataccgcggtgttacaaggcatcggtggacaggtagatacgaggcacatttatgggacaatagttgcaaaagagaaggccagactcgcaaaggaagacaagtttatctgggaggttatgacaaagaagaaaaagcagctagggcttacgatttagccgcactaaagtattggggaaccaccactactactaacttccccttgagtgaatatgagaaagaggtagaagagatgaagcacatgacgaggcaagagtatgttgcctctctgcgcaggaaaagtagtggtttctctcgtggtgcatcgatttatcgaggagtaacaaggcatcaccaacatggaaggtggcaagctaggatcggaagagtcgccggtaacaaagacctctacttgggaactttcggcacacaggaagaggctgctgaggcttatgacattgcagccattaaattcagaggattaagcgcagtgactaacttcgacatgaacagatacaatgttaaagcaatcctcgagagcccgagtctacctattggtagttctgcgaaacgtctcaaggacgttaataatccggttccagctatgatgattagtaataacgtttcagagagtgcaaataatgttagcggttggcaaaacactgcgtttcagcatcatcagggaatggatttgagcttattgcagcaacagcaggagaggtacgttggttattacaatggaggaaacttgtctaccgagagtactagggtttgtttcaaacaagaggaggaacaacaacacttcttgagaaactcgccgagtcacatgactaatgttgatcatcatagctcgacctctgatgattctgttaccgtttgtggaaatgttgttagttatggtggttatcaaggattcgcaatccctgttggaacatcggttaattacgatccctttactgctgctgagattgcttacaacgcaagaaatcattattactatgctcagcatcagcaacaacagcagattcagcagtcgccgggaggagattttccggtggcgatttcgaataaccatagctctaacatgtactttcacggggaaggtggtggagaaggggctccaacgttttcagtttggaacgacacttag

SEQ ID NO: 441 - DNA, 2061 bp, Medicago truncatula
atgaacttgttaggtttctctctatctccacaagaacaacatccatcaacacaagatcaaacggtggcttcccgttttgggttcaaccctaatgaaatctcaggctctgatgttcaaggagatcactgctatgatctctcttctcacacaactcctcatcattcactcaacctttctcatcctttttccatttatgaagctttccacacaaataacaacattcacaccactcaagattggaaggagaactacaacaaccaaaacctactattgggaacatcatgcatgaaccaaaatgtgaacaacaacaaccaacaagcacaaccaaagctagaaaacttcctcggtggacactctttcaccgaccatcaagaatacggtggtagcaactcatactcttcattacacctcccacctcatcagccggaagcatcctgtggcggtggtgatggtagtacaagtaacaataactcaataggtttatctatgataaaaacatggctcagaaaccaaccaccaccaccagaaaacaacaacaataacaacaatgaaagtggtgcacgtgtgcagacactatcactttctatgagtactggctcacagtcaagttcatctgtgcctcttctcaatgcaaatgtgatgagtggtgagatttcctcatcggaaaacaaacaaccacccacaactgcagttgtacttgatagcaaccaaacaagtgtcgttgaaagtgctgtgcctagaaaatccgttgatacatttggacaaagaacttccatttaccgtggtgtaacaaggcatagatggacagggagatatgaagctcacctttgggataatagttgtagaagagaggggcagactcgcaaaggaaggcaagtttacttgggaggttatgacaaagaagaaaaagcagctagagcctatgatttggcagcactaaaatattggggaacaactactacaacaaattttccaattagccattatgaaaaagaagtggaagaaatgaagcatatgacaaggcaagagtacgttgcgtcattgagaaggaaaagtagtggtttttcacgaggtgcatccatttaccgaggagtaacaagacatcatcaacatggtagatggcaagctaggattggaagagttgcaggcaacaaagatctctacctaggaactttcagcactcaagaagaggcagcagaggcatatgatgtggcagcaataaaattcagaggactgagtgcagttacaaactttgacatgagcagatatgatgtcaaaaccatacttgagagcagcacattaccaattggtggtgctgcaaagcgtttaaaagacatggagcaagttgaattgaatcatgtgaatgttgatattagccatagaactgaacaagatcatagcatcatcaacaacacttcccatttaacagaacaagccatctatgcagcaacaaatgcatctaattggcatgcactttcattccaacatcaacaaccacatcatcattacaatgccaacaacatgcagttacagaattatccttatggaactcaaactcaaaagctttggtgcaaacaagaacaagattctgatgatcatagtacttatactactgctactgatattcatcaactacagttagggaataataataacaatactcacaatttctttggtttacaaaatatcatgagtatggattctgcttccatggataatagttctggatctaattctgttgtttatggtggtggagatcatggtggttatggaggaaatggtggatatatgattccaatggctattgcaaatgatggtaaccaaaatccaagaagcaacaacaattttggtgagagtgagattaaaggatttggttatgaaaatgtttttgggactactactgatccttatcatgcacaggcagcaaggaacttgtactatcagccacaacaattatctgttgatcaaggatcaaattgggttccaactgctattccaacacttgctccaaggactaccaatgtctctctatgtcctcctttcactttgttgcatgaatag

SEQ ID NO: 442 - protein, 363 aa, Arabidopsis thaliana
MDNFLPFPSSNANSVQELSMDPNNNRSHFTTVPTYDHHQAQPHHFLPPFSYPVEQMAAVMNPQPVYLSECYPQIPVTQTGSEFGSLVGNPCLWQERGGFLDPRMTKMARINRKNAMMRSRNNSSPNSSPSELVDSKRQLMMLNLKNNVQISDKKDSYQQSTFDNKKLRVLCEKELKNSDVGSLGRIVLPKRDAEANLPKLSDKEGIVVQMRDVFSMQSWSFKYKFWSNNKSRMYVLENTGEFVKQNGAEIGDFLTIYEDESKNLYFAMNGNSGKQNEGRENESRERNHYEEAMLDYIPRDEEEASIAMLIGNLNDHYPIPNDLMDLTTDLQHHQATSSSMPPEDHAYVGSSDDQVSFNDFEWW

SEQ ID NO: 443 - protein, 280 aa, Medicago truncatula
MSSSNFSCILSISLTFFILLLNKVNSAETTSFSITKFVPDQKNLIFQGDAKTASTGKLELSKAVKNSIGRALYSAPIHIWDSKTGSVANFQTTFTFTITAPNTYNVADGLAFFIAPIDTKPKSIHHGGYLGVFDSKTYKKSIQTVAVEIDTFYNAQWDPNPGNISSTGRHIGIDVNSIKSISTVPWSLENNKKANVAIGFNGATNVLSVDVEYPLIRHYTLSHVVPLKDVVPEWVRIGFSSSTGAEYSAHDILSWSFDSKLNLGFENNINANVSSSTQAA

SEQ ID NO: 444 - protein, 349 aa, Brassica napus
MDNFLPFSSSNANSVQELSMDLNKNRSHFSMAQPQHLLPPYSYVACPALDQTGTMNHQPLHSSDAFPQIPVVQTGGEFGYLVCKPGVRQERGGFLDPHSTKMARINRKKAMLRSRNNSNPNSSSNELVDSRRQVALTMKNNAEIAARKDFYRFSSFDNKKLRVLLVKHLKNSDVGSLGRIVLPKREAEGNLPELSDKEGMVLEMRDVDSVQSWSFKYKYWSNNKSRMYVLENTGEFVKKNGVLMGDYLTIYEDESKNLYFSIRKHPHKQNDGREDESMEVIEMNFYEDIMFDYIPNDEDDSIAMLLGNLNEHYPYPNDLMDLTVNLDQHQQATSSSPPADHMSSNDFLW

SEQ ID NO: 445 - protein, 584 aa, Arabidopsis thaliana
MNSMNNWLGFSLSPHDQNHHRTDVDSSTTRTAVDVAGGYCFDLAAPSDESSAVQTSFLSPFGVTLEAFTRDNNSHSRDWDINGGACNNINNNEQNGPKLENFLGRTTTIYNTNETVVDGNGDCGGGDGGGGGSLGLSMIKTWLSNHSVANANHQDNGNGARGLSLSMNSSTSDSNNYNNNDDVVQEKTIVDVVETTPKKTIESFGQRTSIYRGVTRHRWTGRYEAHLWDNSCKREGQTRKGRQVYLGGYDKEEKAARAYDLAALKYWGTTTTTNFPLSEYEKEVEEMKHMTRQEYVASLRRKSSGFSRGASIYRGVTRHHQHGRWQARIGRVAGNKDLYLGTFGTQEEAAEAYDIAAIKFRGLSAVTNFDMNRYNVKAILESPSLPIGSSAKRLKDVNNPVPAMMISNNVSESANNVSGWQNTAFQHHQGMDLSLLQQQQERYVGYYNGGNLSTESTRVCFKQEEEQQHFLRNSPSHMTNVDHHSSTSDDSVTVCGNVVSYGGYQGFAIPVGTSVNYDPFTAAEIAYNARNHYYYAQHQQQQQIQQSPGGDFPVAISNNHSSNMYFHGEGGGEGAPTFSVWNDT

SEQ ID NO: 446 - protein, 686 aa, Medicago truncatula
MNLLGFSLSPQEQHPSTQDQTVASRFGFNPNEISGSDVQGDHCYDLSSHTTPHHSLNLSHPFSIYEAFHTNNNIHTTQDWKENYNNQNLLLGTSCMNQNVNNNNQQAQPKLENFLGGHSFTDHQEYGGSNSYSSLHLPPHQPEASCGGGDGSTSNNNSIGLSMIKTWLRNQPPPPENNNNNNNESGARVQTLSLSMSTGSQSSSSVPLLNANVMSGEISSSENKQPPTTAVVLDSNQTSVVESAVPRKSVDTFGQRTSIYRGVTRHRWTGRYEAHLWDNSCRREGQTRKGRQVYLGGYDKEEKAARAYDLAALKYWGTTTTTNFPISHYEKEVEEMKHMTRQEYVASLRRKSSGFSRGASIYRGVTRHHQHGRWQARIGRVAGNKDLYLGTFSTQEEAAEAYDVAAIKFRGLSAVTNFDMSRYDVKTILESSTLPIGGAAKRLKDMEQVELNHVNVDISHRTEQDHSIINNTSHLTEQAIYAATNASNWHALSFQHQQPHHHYNANNMQLQNYPYGTQTQKLWCKQEQDSDDHSTYTTATDIHQLQLGNNNNNTHNFFGLQNIMSMDSASMDNSSGSNSVVYGGGDHGGYGGNGGYMIPMAIANDGNQNPRSNNNFGESEIKGFGYENVFGTTTDPYHAQAARNLYYQPQQLSVDQGSNWVPTAIPTLAPRTTNVSLCPPFTLLHE

SEQ ID NO: 447 - DNA, 336 bp, Artificial Sequence
  inducible promoter
tcgatagttgtgatagttcccacttgtccgtccgcatcggcatccgcagctcgggatagttccgacctaggattggatgcatgcggaaccgcacgagggcggggcggaaattgacacaccactcctctccacgcaccgttcaagaggtacgcgtatagagccgtatagagcagagacggagcactttctggtactgtccgcacgggatgtccgcacggagagccacaaacgagcggggccccgtacgtgctctcctaccccaggatcgcatccccgcatagctgaacatctatataaagacccccaaggttctcagtctcaccaacatcatcaacc

SEQ ID NO: 448 - DNA, 2466 bp, Artificial Sequence
  inducer
atggccgacactagaagaaggcagaaccactcttgtgacccatgccgtaagggcaagagaagatgtgatgctccagagaaccgtaacgaggctaatgagaacggatgggtgtcatgctctaactgcaagaggtggaacaaggactgcaccttcaactggcttagctcccaaaggtctaaggctaagggtgctgctccaagagctaggactaagaaggctaggactgctactactacctccgagccttctacttccgctgctactattccaactcccgagtccgataatcacgatgctccaccagtgatcaactcccacgatgctttgccatcttggactcagggacttctttctcaccctggcgatctcttcgacttctcccattctgctattccagctaacgctgaggatgctgctaacgtgcaatctgatgctccattcccatgggatcttgctatcccaggcgatttctctatgggacagcaacttgagaagcccctctccccattgtctttccaggctgttcttcttccaccacactccccaaacactgatgatctcattcgtgagcttgaggaacagactaccgatccagattccgtgactgacactaactccgttcagcaagttgctcaggatggctctctttggtctgataggcagtctccactcctcccagaaaacagtttgtgcatggcttccgactctaccgctagaaggtatgctaggtccaccatgaccaagaacctcatgaggatctaccacgactccatggaaaacgccctttcttgctggcttactgagcacaactgcccatactccgaccagatttcttacctcccaccaaagcaaagggctgagtggggaccaaattggtctaacaggatgtgcattagggtgtgcaggctcgatagggtgtcaacttctcttagaggaagggctctctccgctgaagaagataaggctgctgctagggcacttcaccttgctattgtggctttcgcttctcagtggactcaacatgctcaaaggggagctggacttaacgtcccagctgatattgctgctgacgagcgttctattaggcgtaacgcttggaatgaggctaggcatgcacttcagcacactactggaatcccatccttcagggtgatcttcgccaacatcatcttcagcctcactcagtccgtgctcgatgatgatgagcaacatggaatgggagctaggctcgataagcttctcgagaatgatggtgctccagtgttcctcgagactgctaataggcagctctacaccttcaggcacaagttcgctaggatgcagagaaggggtaaggctttcaataggcttcctggtggatccgtggcttctactttcgctggaattttcgagactcccaccccctcatctgagtctccacaacttgatccagtggtggcttctgaggaacacaggtctactctgtctctcatgttctggctcgggatcatgttcgacactctgtctgctgctatgtaccagaggccacttgttgtgtccgatgaggactcccagatctcttctgcttctccaccaagaagaggtgccgagactcctattaaccttgattgctgggagccaccaaggcaggtcccatctaatcaagagaagtctgatgtgtggggcgacctgttccttaggacttctgattctttgcccgaccacgagtcccacactcaaatttctcaaccagctgctaggtggccatgcacttatgaacaagctgctgctgctctctcctctgctactcctgttaaggtgttgctttacaggcgtgtgactcagctccagactttgttgtataggggagcttctccagctaggcttgaggctgctattcagaggactctctacgtgtacaaccactggactgctaagtaccagccattcatgcaggattgcgttgccaaccatgagcttctcccatccaggatccagtcttggtacgtgatccttgatggacactggcaccttgctgctatgcttttggctgatgtgctcgagtccatcgacagggattcctactccgatatcaaccacatcgacctcgtgactaagctcaggcttgataacgctcttgctgtgtctgctctcgctaggtcatctcttagaggccaagaactcgatccaggcaaggcttctccaatgtacaggcacttccacgactcccttactgaggttgcattccttgttgagccatggactgtggtgctcatccactcatttgctaaggctgcttacatcctcctcgattgccttgatcttgatggtcagggaaacgctctcgctggataccttcaacttaggcagaactgcaactactgcatcagggctctccagttccttggccgtaagtctgatatggctgctctcgtggctaaggatcttgagaggggactcaacggaaaggtcgacagcttcctctaa

That which is claimed is:

1. An adeno-associated virus (AAV) capsid protein that comprises an AAV2.5 VP 1 capsid protein, further comprising amino acid substitutions that introduce a galactose-binding site, wherein the amino acid substitutions comprise Q465V, A468P, D470N, I471M, R472A, D473V, S475G, Y501F, and S502A, wherein the amino acid sequence is SEQ ID NO:2.

2. The AAV capsid protein of claim 1, which further comprises an amino acid substitution at the position corresponding to amino acid 267 of AAV2.5 which is not a serine.

3. The AAV capsid protein of claim 1 or 2, wherein the capsid protein confers dual glycan binding ability to an AAV vector.

4. An AAV capsid comprising the AAV capsid protein of claim 1 or 2.

5. An AAV vector comprising:
   (a) the AAV capsid of claim 4; and
   (b) a nucleic acid comprising at least one terminal repeat sequence,
   wherein the nucleic acid is encapsidated by the AAV capsid.

6. The AAV vector of claim 5 that is formulated in a pharmaceutically acceptable carrier.

7. A method of introducing a nucleic acid into a cell, comprising contacting the cell with the AAV vector of claim 5.

8. The method of claim 7, wherein the cell is in neural tissue.

9. The method of claim 8, wherein the cell is a neuron or a glial cell.

10. The method of claim 9, wherein the glial cell is an astrocyte.

11. The method of claim 8, wherein the AAV vector has enhanced transduction of neural tissue as compared to an AAV1, AAV2, AAV9, or AAV2.5 virus vector.

12. The method of claim 7, wherein the cell is in a subject.

13. The method of claim 12, wherein the subject is a human subject.

14. The method of claim 13, wherein the subject is a child.

15. The method of claim 14, wherein the child is an infant.

16. The method of claim 12, wherein the subject is in utero.

17. The method of claim 12, wherein the subject has a reduced immunologic profile when contacted with the AAV vector of claim 8 as compared to when contacted with an AAV1, AAV2, AAV9, or AAV2.5 virus vector.

18. The method of claim 12, wherein the nucleic acid is a therapeutic nucleic acid and the AAV vector is administered to the subject under conditions whereby the therapeutic nucleic acid is expressed in the cell of the subject.

19. The method of claim 12, wherein the subject has or is at risk for a central nervous system (CNS) disease or disorder.

20. The method of claim 12, wherein the subject has or is at risk for a congenital neurodegenerative disorder.

21. The method of claim 12, wherein the subject has or is at risk for adult-onset autosomal dominant leukodystrophy (ADLD), Aicardi-Goutieres syndrome, Alexander disease, CADASIL, Canavan disease, CARASIL, cerebrotendinous xanthomatosis, childhood ataxia and cerebral hypomyelination (CACH)/vanishing white matter disease (VWMD), Fabry disease, fucosidosis, GM1 gangliosidosis, Krabbe disease, L-2-hydroxyglutaric aciduria megalencephalic leukoencephalopathy with subcortical cysts, metachromatic leukodystrophy, multiple sulfatase deficiency, Pelizaeus-Merzbacher disease, Pal III-Related Leukodystrophies, Refsum disease, salla disease (free sialic acid storage disease), Sjogren-Larsson syndrome, X-linked adrenoleukodystrophy, Zellweger syndrome spectrum disorders, Mucopolysaccharidosis Type I, Mucopolysaccharidosis Type II, Mucopolysaccharidosis Type III, Mucopolysaccharidosis Type IV, Mucopolysaccharidosis Type V, Mucopolysaccharidosis Type VI, Mucopolysaccharidosis Type VII, Mucopolysaccharidosis Type IX and any combination thereof.

22. The method of claim 12, wherein the subject has or is at risk of having pain associated with a disease or disorder.

23. The method of claim 12, wherein the AAV vector is delivered to the subject via an enteral, parenteral, intrathecal, intracisternal, intracerebral, intraventricular, intranasal, intra-aural, intra-ocular, peri-ocular, intrarectal, intramuscular, intraperitoneal, intravenous, oral, sublingual, subcutaneous and/or transdermal route, to thereby contact the cell.

24. The method of claim 12, wherein the AAV vector is delivered intracranially and/or intraspinally, to the subject to thereby contact the cell.

* * * * *